United States Patent 10,738,302 (COMPOSITIONS AND METHODS FOR IDENTIFYING POLYNUCLEOTIDES OF INTEREST) - sequence listing, part 3

SEQ ID NO: 68640 - DNA, 18 bp, Artificial Sequence
  Synthetic DNA
tacatcgtatcactatag

SEQ ID NO: 68641 - DNA, 18 bp, Artificial Sequence
  Synthetic DNA
taccacgacccagtctag

SEQ ID NO: 68642 - DNA, 18 bp, Artificial Sequence
  Synthetic DNA
taccacgactctattttg

SEQ ID NO: 68643 - DNA, 18 bp, Artificial Sequence
  Synthetic DNA
taccccgagttactctag

SEQ ID NO: 68644 - DNA, 18 bp, Artificial Sequence
  Synthetic DNA
tacctagcttaactaaag

SEQ ID NO: 68645 - DNA, 18 bp, Artificial Sequence
  Synthetic DNA
tacctcgacgtactctcg

SEQ ID NO: 68646 - DNA, 18 bp, Artificial Sequence
  Synthetic DNA
tacgccgtctcacaatag

SEQ ID NO: 68647 - DNA, 18 bp, Artificial Sequence
  Synthetic DNA
tacgtggactctctttag

SEQ ID NO: 68648 - DNA, 18 bp, Artificial Sequence
  Synthetic DNA
tactacaactcttgtttg

SEQ ID NO: 68649 - DNA, 18 bp, Artificial Sequence
  Synthetic DNA
tactacaacttatttatg

SEQ ID NO: 68650 - DNA, 18 bp, Artificial Sequence
  Synthetic DNA
tactaccaagcactaaag

SEQ ID NO: 68651 - DNA, 18 bp, Artificial Sequence
  Synthetic DNA
tactaccacttattacag

SEQ ID NO: 68652 - DNA, 18 bp, Artificial Sequence
  Synthetic DNA
tactacgaatcacatttg

SEQ ID NO: 68653 - DNA, 18 bp, Artificial Sequence
  Synthetic DNA
tactacgcgtctcaatag

SEQ ID NO: 68654 - DNA, 18 bp, Artificial Sequence
  Synthetic DNA
tactactactcatttatg

SEQ ID NO: 68655 - DNA, 18 bp, Artificial Sequence
  Synthetic DNA
tactacttttatgtccag

SEQ ID NO: 68656 - DNA, 18 bp, Artificial Sequence
  Synthetic DNA
tactataactttttatag

SEQ ID NO: 68657 - DNA, 18 bp, Artificial Sequence
  Synthetic DNA
tactatgactcacaaatg

SEQ ID NO: 68658 - DNA, 18 bp, Artificial Sequence
  Synthetic DNA
tactatgacttcttatag

SEQ ID NO: 68659 - DNA, 18 bp, Artificial Sequence
  Synthetic DNA
tactccgacagcctatag

SEQ ID NO: 68660 - DNA, 18 bp, Artificial Sequence
  Synthetic DNA
tactgcgacacacgttac

SEQ ID NO: 68661 - DNA, 18 bp, Artificial Sequence
  Synthetic DNA
tactgtgacttagtatag

SEQ ID NO: 68662 - DNA, 18 bp, Artificial Sequence
  Synthetic DNA
tacttcaactctctgaag

SEQ ID NO: 68663 - DNA, 18 bp, Artificial Sequence
  Synthetic DNA
tacttcgactctctgatg

SEQ ID NO: 68664 - DNA, 18 bp, Artificial Sequence
  Synthetic DNA
tacttcggctcactaatg

SEQ ID NO: 68665 - DNA, 18 bp, Artificial Sequence
  Synthetic DNA
tacttcgtctaacttcag

SEQ ID NO: 68666 - DNA, 18 bp, Artificial Sequence
  Synthetic DNA
tacttcgtctctctattg

SEQ ID NO: 68667 - DNA, 18 bp, Artificial Sequence
  Synthetic DNA
tacttctactctaaatag

SEQ ID NO: 68668 - DNA, 18 bp, Artificial Sequence
  Synthetic DNA
tactttgacttacaatag

SEQ ID NO: 68669 - DNA, 18 bp, Artificial Sequence
  Synthetic DNA
tagaaacttttactaaag

SEQ ID NO: 68670 - DNA, 18 bp, Artificial Sequence
  Synthetic DNA
tagaacgtcacattaaag

SEQ ID NO: 68671 - DNA, 18 bp, Artificial Sequence
  Synthetic DNA
tagaactaaacacttatg

SEQ ID NO: 68672 - DNA, 18 bp, Artificial Sequence
  Synthetic DNA
tagaccgactctctatgg

SEQ ID NO: 68673 - DNA, 18 bp, Artificial Sequence
  Synthetic DNA
tagagcgaatctatctgg

SEQ ID NO: 68674 - DNA, 18 bp, Artificial Sequence
  Synthetic DNA
tagatggacttactttag

SEQ ID NO: 68675 - DNA, 18 bp, Artificial Sequence
  Synthetic DNA
tagattgactcccttaag

SEQ ID NO: 68676 - DNA, 18 bp, Artificial Sequence
  Synthetic DNA
tagtaagactctagatag

SEQ ID NO: 68677 - DNA, 18 bp, Artificial Sequence
  Synthetic DNA
tagtacaactctcgttag

SEQ ID NO: 68678 - DNA, 18 bp, Artificial Sequence
  Synthetic DNA
tagtacgacctagtttcg

SEQ ID NO: 68679 - DNA, 18 bp, Artificial Sequence
  Synthetic DNA
tagtacgactatcactag

SEQ ID NO: 68680 - DNA, 18 bp, Artificial Sequence
  Synthetic DNA
tagtacgactttatttag

SEQ ID NO: 68681 - DNA, 18 bp, Artificial Sequence
  Synthetic DNA
tagtacgtagctctatag

SEQ ID NO: 68682 - DNA, 18 bp, Artificial Sequence
  Synthetic DNA
tagtacgtctgactcatg

SEQ ID NO: 68683 - DNA, 18 bp, Artificial Sequence
  Synthetic DNA
tagtacgtgtaactattg

SEQ ID NO: 68684 - DNA, 18 bp, Artificial Sequence
  Synthetic DNA
tagtactactcaataatg

SEQ ID NO: 68685 - DNA, 18 bp, Artificial Sequence
  Synthetic DNA
tagtactactctccttag

SEQ ID NO: 68686 - DNA, 18 bp, Artificial Sequence
  Synthetic DNA
tagtactattcacagtag

SEQ ID NO: 68687 - DNA, 18 bp, Artificial Sequence
  Synthetic DNA
tagtccgacacgtaattg

SEQ ID NO: 68688 - DNA, 18 bp, Artificial Sequence
  Synthetic DNA
tagtccgacatactattg

SEQ ID NO: 68689 - DNA, 18 bp, Artificial Sequence
  Synthetic DNA
tagtccgagtcaccagag

SEQ ID NO: 68690 - DNA, 18 bp, Artificial Sequence
  Synthetic DNA
tagtgcttctcacaaaag

SEQ ID NO: 68691 - DNA, 18 bp, Artificial Sequence
  Synthetic DNA
tagttatacacgctatag

SEQ ID NO: 68692 - DNA, 18 bp, Artificial Sequence
  Synthetic DNA
tagttcaactcgctacag

SEQ ID NO: 68693 - DNA, 18 bp, Artificial Sequence
  Synthetic DNA
tagttcgactccatatcg

SEQ ID NO: 68694 - DNA, 18 bp, Artificial Sequence
  Synthetic DNA
tagttcgccacattaaag

SEQ ID NO: 68695 - DNA, 18 bp, Artificial Sequence
  Synthetic DNA
tagttcgtatcaatatag

SEQ ID NO: 68696 - DNA, 18 bp, Artificial Sequence
  Synthetic DNA
tagttcgtcagactatag

SEQ ID NO: 68697 - DNA, 18 bp, Artificial Sequence
  Synthetic DNA
tagtttgtctgactatag

SEQ ID NO: 68698 - DNA, 18 bp, Artificial Sequence
  Synthetic DNA
tataacaacacaatattg

SEQ ID NO: 68699 - DNA, 18 bp, Artificial Sequence
  Synthetic DNA
tataaccactcactcaag

SEQ ID NO: 68700 - DNA, 18 bp, Artificial Sequence
  Synthetic DNA
tataaccactctcaaagg

SEQ ID NO: 68701 - DNA, 18 bp, Artificial Sequence
  Synthetic DNA
tataaccacttagcatag

SEQ ID NO: 68702 - DNA, 18 bp, Artificial Sequence
  Synthetic DNA
tataacgaatctatatag

SEQ ID NO: 68703 - DNA, 18 bp, Artificial Sequence
  Synthetic DNA
tataacgactaactaatg

SEQ ID NO: 68704 - DNA, 18 bp, Artificial Sequence
  Synthetic DNA
tataacgactatcaatag

SEQ ID NO: 68705 - DNA, 18 bp, Artificial Sequence
  Synthetic DNA
tataacgactctcagtag

SEQ ID NO: 68706 - DNA, 18 bp, Artificial Sequence
  Synthetic DNA
tataacgattcactcaag

SEQ ID NO: 68707 - DNA, 18 bp, Artificial Sequence
  Synthetic DNA
tataacgccacagattgg

SEQ ID NO: 68708 - DNA, 18 bp, Artificial Sequence
  Synthetic DNA
tataacgcctcactaatg

SEQ ID NO: 68709 - DNA, 18 bp, Artificial Sequence
  Synthetic DNA
tataacgtcgtactcatg

SEQ ID NO: 68710 - DNA, 18 bp, Artificial Sequence
  Synthetic DNA
tataactactaactcgag

SEQ ID NO: 68711 - DNA, 18 bp, Artificial Sequence
  Synthetic DNA
tataactccacacaatag

SEQ ID NO: 68712 - DNA, 18 bp, Artificial Sequence
  Synthetic DNA
tataacttctcattatag

SEQ ID NO: 68713 - DNA, 18 bp, Artificial Sequence
  Synthetic DNA
tataaggtctctctctag

SEQ ID NO: 68714 - DNA, 18 bp, Artificial Sequence
  Synthetic DNA
tatataaacgcactaaag

SEQ ID NO: 68715 - DNA, 18 bp, Artificial Sequence
  Synthetic DNA
tatatctacacattaacg

SEQ ID NO: 68716 - DNA, 18 bp, Artificial Sequence
  Synthetic DNA
tatcaagacttattatag

SEQ ID NO: 68717 - DNA, 18 bp, Artificial Sequence
  Synthetic DNA
tatcacaaaacacgatcg

SEQ ID NO: 68718 - DNA, 18 bp, Artificial Sequence
  Synthetic DNA
tatcaccattgactcaag

SEQ ID NO: 68719 - DNA, 18 bp, Artificial Sequence
  Synthetic DNA
tatcacgactttttatag

SEQ ID NO: 68720 - DNA, 18 bp, Artificial Sequence
  Synthetic DNA
tatcacgtttcactctag

SEQ ID NO: 68721 - DNA, 18 bp, Artificial Sequence
  Synthetic DNA
tatcgttattatctatag

SEQ ID NO: 68722 - DNA, 18 bp, Artificial Sequence
  Synthetic DNA
tatctcgattctccatag

SEQ ID NO: 68723 - DNA, 18 bp, Artificial Sequence
  Synthetic DNA
tatctctaatcacaattg

SEQ ID NO: 68724 - DNA, 18 bp, Artificial Sequence
  Synthetic DNA
tatctggccacacaatag

SEQ ID NO: 68725 - DNA, 18 bp, Artificial Sequence
  Synthetic DNA
tatgaagcatatgtatag

SEQ ID NO: 68726 - DNA, 18 bp, Artificial Sequence
  Synthetic DNA
tatgacgtctcactcaag

SEQ ID NO: 68727 - DNA, 18 bp, Artificial Sequence
  Synthetic DNA
tatgagtcctcactaaag

SEQ ID NO: 68728 - DNA, 18 bp, Artificial Sequence
  Synthetic DNA
tatgccatcactctaaag

SEQ ID NO: 68729 - DNA, 18 bp, Artificial Sequence
  Synthetic DNA
tattaaaacccattatag

SEQ ID NO: 68730 - DNA, 18 bp, Artificial Sequence
  Synthetic DNA
tattaaccgtctctttag

SEQ ID NO: 68731 - DNA, 18 bp, Artificial Sequence
  Synthetic DNA
tattaagacaatcaaaag

SEQ ID NO: 68732 - DNA, 18 bp, Artificial Sequence
  Synthetic DNA
tattacaacacacattag

SEQ ID NO: 68733 - DNA, 18 bp, Artificial Sequence
  Synthetic DNA
tattacaacgttctatag

SEQ ID NO: 68734 - DNA, 18 bp, Artificial Sequence
  Synthetic DNA
tattacaactaaatttag

SEQ ID NO: 68735 - DNA, 18 bp, Artificial Sequence
  Synthetic DNA
tattacaactatcgaaag

SEQ ID NO: 68736 - DNA, 18 bp, Artificial Sequence
  Synthetic DNA
tattacaattctctattg

SEQ ID NO: 68737 - DNA, 18 bp, Artificial Sequence
  Synthetic DNA
tattaccactcaaaatcg

SEQ ID NO: 68738 - DNA, 18 bp, Artificial Sequence
  Synthetic DNA
tattacgaataattaccg

SEQ ID NO: 68739 - DNA, 18 bp, Artificial Sequence
  Synthetic DNA
tattacgacacaatagcg

SEQ ID NO: 68740 - DNA, 18 bp, Artificial Sequence
  Synthetic DNA
tattacgacacatcttag

SEQ ID NO: 68741 - DNA, 18 bp, Artificial Sequence
  Synthetic DNA
tattacgacatgctttag

SEQ ID NO: 68742 - DNA, 18 bp, Artificial Sequence
  Synthetic DNA
tattacgaccctacatag

SEQ ID NO: 68743 - DNA, 18 bp, Artificial Sequence
  Synthetic DNA
tattacgactcgctcatg

SEQ ID NO: 68744 - DNA, 18 bp, Artificial Sequence
  Synthetic DNA
tattacgactcgcttctg

SEQ ID NO: 68745 - DNA, 18 bp, Artificial Sequence
  Synthetic DNA
tattacgattctaaatag

SEQ ID NO: 68746 - DNA, 18 bp, Artificial Sequence
  Synthetic DNA
tattacgcctagctttag

SEQ ID NO: 68747 - DNA, 18 bp, Artificial Sequence
  Synthetic DNA
tattacgcctattaatcg

SEQ ID NO: 68748 - DNA, 18 bp, Artificial Sequence
  Synthetic DNA
tattacgcttcaccgtag

SEQ ID NO: 68749 - DNA, 18 bp, Artificial Sequence
  Synthetic DNA
tattacgtatctgcatag

SEQ ID NO: 68750 - DNA, 18 bp, Artificial Sequence
  Synthetic DNA
tattacgtctaacaccag

SEQ ID NO: 68751 - DNA, 18 bp, Artificial Sequence
  Synthetic DNA
tattacgtctcattgttg

SEQ ID NO: 68752 - DNA, 18 bp, Artificial Sequence
  Synthetic DNA
tattacgttatcctttag

SEQ ID NO: 68753 - DNA, 18 bp, Artificial Sequence
  Synthetic DNA
tattacgtttcaatattg

SEQ ID NO: 68754 - DNA, 18 bp, Artificial Sequence
  Synthetic DNA
tattacgttttattatag

SEQ ID NO: 68755 - DNA, 18 bp, Artificial Sequence
  Synthetic DNA
tattactaaacactagag

SEQ ID NO: 68756 - DNA, 18 bp, Artificial Sequence
  Synthetic DNA
tattactaatctctttag

SEQ ID NO: 68757 - DNA, 18 bp, Artificial Sequence
  Synthetic DNA
tattactaattacaatag

SEQ ID NO: 68758 - DNA, 18 bp, Artificial Sequence
  Synthetic DNA
tattactacatattatag

SEQ ID NO: 68759 - DNA, 18 bp, Artificial Sequence
  Synthetic DNA
tattactaccatcgattg

SEQ ID NO: 68760 - DNA, 18 bp, Artificial Sequence
  Synthetic DNA
tattactactgtctattg

SEQ ID NO: 68761 - DNA, 18 bp, Artificial Sequence
  Synthetic DNA
tattactcctcactcaag

SEQ ID NO: 68762 - DNA, 18 bp, Artificial Sequence
  Synthetic DNA
tattactcttcacttttg

SEQ ID NO: 68763 - DNA, 18 bp, Artificial Sequence
  Synthetic DNA
tattactgctctctttag

SEQ ID NO: 68764 - DNA, 18 bp, Artificial Sequence
  Synthetic DNA
tattacttatcactatgg

SEQ ID NO: 68765 - DNA, 18 bp, Artificial Sequence
  Synthetic DNA
tattacttcccacaatgg

SEQ ID NO: 68766 - DNA, 18 bp, Artificial Sequence
  Synthetic DNA
tattacttctcacagttg

SEQ ID NO: 68767 - DNA, 18 bp, Artificial Sequence
  Synthetic DNA
tattacttctcactcttg

SEQ ID NO: 68768 - DNA, 18 bp, Artificial Sequence
  Synthetic DNA
tattaggactcatattag

SEQ ID NO: 68769 - DNA, 18 bp, Artificial Sequence
  Synthetic DNA
tattaggactcatttttg

SEQ ID NO: 68770 - DNA, 18 bp, Artificial Sequence
  Synthetic DNA
tattaggactttctattg

SEQ ID NO: 68771 - DNA, 18 bp, Artificial Sequence
  Synthetic DNA
tattaggatacactaatg

SEQ ID NO: 68772 - DNA, 18 bp, Artificial Sequence
  Synthetic DNA
tattatcactcacaaaag

SEQ ID NO: 68773 - DNA, 18 bp, Artificial Sequence
  Synthetic DNA
tattatgaatcacattag

SEQ ID NO: 68774 - DNA, 18 bp, Artificial Sequence
  Synthetic DNA
tattatgactcgcataag

SEQ ID NO: 68775 - DNA, 18 bp, Artificial Sequence
  Synthetic DNA
tattatgatccgcattag

SEQ ID NO: 68776 - DNA, 18 bp, Artificial Sequence
  Synthetic DNA
tattatgcatctctatag

SEQ ID NO: 68777 - DNA, 18 bp, Artificial Sequence
  Synthetic DNA
tattatgtttctctatag

SEQ ID NO: 68778 - DNA, 18 bp, Artificial Sequence
  Synthetic DNA
tattatttaacattatag

SEQ ID NO: 68779 - DNA, 18 bp, Artificial Sequence
  Synthetic DNA
tattccgacgcaaggtcg

SEQ ID NO: 68780 - DNA, 18 bp, Artificial Sequence
  Synthetic DNA
tattcggactgcctatag

SEQ ID NO: 68781 - DNA, 18 bp, Artificial Sequence
  Synthetic DNA
tattgagtctcactaaag

SEQ ID NO: 68782 - DNA, 18 bp, Artificial Sequence
  Synthetic DNA
tattgccactcgttactg

SEQ ID NO: 68783 - DNA, 18 bp, Artificial Sequence
  Synthetic DNA
tattgcgactcagtcaag

SEQ ID NO: 68784 - DNA, 18 bp, Artificial Sequence
  Synthetic DNA
tattgcgtttcactctag

SEQ ID NO: 68785 - DNA, 18 bp, Artificial Sequence
  Synthetic DNA
tattgctaatcattactg

SEQ ID NO: 68786 - DNA, 18 bp, Artificial Sequence
  Synthetic DNA
tattgctactcattttag

SEQ ID NO: 68787 - DNA, 18 bp, Artificial Sequence
  Synthetic DNA
tattgctacttacaacag

SEQ ID NO: 68788 - DNA, 18 bp, Artificial Sequence
  Synthetic DNA
tatttacaataactatag

SEQ ID NO: 68789 - DNA, 18 bp, Artificial Sequence
  Synthetic DNA
tatttagtctcacttctg

SEQ ID NO: 68790 - DNA, 18 bp, Artificial Sequence
  Synthetic DNA
tatttcaattcactttag

SEQ ID NO: 68791 - DNA, 18 bp, Artificial Sequence
  Synthetic DNA
tatttccactctgaattg

SEQ ID NO: 68792 - DNA, 18 bp, Artificial Sequence
  Synthetic DNA
tatttcgactcacacttg

SEQ ID NO: 68793 - DNA, 18 bp, Artificial Sequence
  Synthetic DNA
tatttcgacttaccaaag

SEQ ID NO: 68794 - DNA, 18 bp, Artificial Sequence
  Synthetic DNA
tatttcgacttacttttg

SEQ ID NO: 68795 - DNA, 18 bp, Artificial Sequence
  Synthetic DNA
tatttcgcctcacattag

SEQ ID NO: 68796 - DNA, 18 bp, Artificial Sequence
  Synthetic DNA
tatttcgccttgctattg

SEQ ID NO: 68797 - DNA, 18 bp, Artificial Sequence
  Synthetic DNA
tatttcgtctagctattg

SEQ ID NO: 68798 - DNA, 18 bp, Artificial Sequence
  Synthetic DNA
tatttcgtcttacacaag

SEQ ID NO: 68799 - DNA, 18 bp, Artificial Sequence
  Synthetic DNA
tatttctactcactaatg

SEQ ID NO: 68800 - DNA, 18 bp, Artificial Sequence
  Synthetic DNA
tatttcttcactctatag

SEQ ID NO: 68801 - DNA, 18 bp, Artificial Sequence
  Synthetic DNA
tatttgcacccactattg

SEQ ID NO: 68802 - DNA, 18 bp, Artificial Sequence
  Synthetic DNA
tatttggacaccctattg

SEQ ID NO: 68803 - DNA, 18 bp, Artificial Sequence
  Synthetic DNA
tattttaacttactatag

SEQ ID NO: 68804 - DNA, 18 bp, Artificial Sequence
  Synthetic DNA
tattttgaccaaatatag

SEQ ID NO: 68805 - DNA, 18 bp, Artificial Sequence
  Synthetic DNA
tattttgaccaagattag

SEQ ID NO: 68806 - DNA, 18 bp, Artificial Sequence
  Synthetic DNA
tcaaacatttcactatag

SEQ ID NO: 68807 - DNA, 18 bp, Artificial Sequence
  Synthetic DNA
tcaaacgccacactgtag

SEQ ID NO: 68808 - DNA, 18 bp, Artificial Sequence
  Synthetic DNA
tcaaactacgcaccgacg

SEQ ID NO: 68809 - DNA, 18 bp, Artificial Sequence
  Synthetic DNA
tcaatagtctcgttattg

SEQ ID NO: 68810 - DNA, 18 bp, Artificial Sequence
  Synthetic DNA
tcaatcgaattaatatgg

SEQ ID NO: 68811 - DNA, 18 bp, Artificial Sequence
  Synthetic DNA
tcaatcgataaattatcg

SEQ ID NO: 68812 - DNA, 18 bp, Artificial Sequence
  Synthetic DNA
tcaatcgtctgattaaag

SEQ ID NO: 68813 - DNA, 18 bp, Artificial Sequence
  Synthetic DNA
tcacaccacccactacag

SEQ ID NO: 68814 - DNA, 18 bp, Artificial Sequence
  Synthetic DNA
tcacacgacacgcaatag

SEQ ID NO: 68815 - DNA, 18 bp, Artificial Sequence
  Synthetic DNA
tcagctcaattactatag

SEQ ID NO: 68816 - DNA, 18 bp, Artificial Sequence
  Synthetic DNA
tcagtggactcactatcg

SEQ ID NO: 68817 - DNA, 18 bp, Artificial Sequence
  Synthetic DNA
tcataagtatcactttag

SEQ ID NO: 68818 - DNA, 18 bp, Artificial Sequence
  Synthetic DNA
tcataagtctttctatag

SEQ ID NO: 68819 - DNA, 18 bp, Artificial Sequence
  Synthetic DNA
tcatacaactcccatctg

SEQ ID NO: 68820 - DNA, 18 bp, Artificial Sequence
  Synthetic DNA
tcatacagctcatttttg

SEQ ID NO: 68821 - DNA, 18 bp, Artificial Sequence
  Synthetic DNA
tcataccaatttacatag

SEQ ID NO: 68822 - DNA, 18 bp, Artificial Sequence
  Synthetic DNA
tcataccactatctcttg

SEQ ID NO: 68823 - DNA, 18 bp, Artificial Sequence
  Synthetic DNA
tcataccgctgccaattg

SEQ ID NO: 68824 - DNA, 18 bp, Artificial Sequence
  Synthetic DNA
tcatacgattcaataatg

SEQ ID NO: 68825 - DNA, 18 bp, Artificial Sequence
  Synthetic DNA
tcatacgcctcacatcag

SEQ ID NO: 68826 - DNA, 18 bp, Artificial Sequence
  Synthetic DNA
tcatacgcctctccttag

SEQ ID NO: 68827 - DNA, 18 bp, Artificial Sequence
  Synthetic DNA
tcatacgcttcagtttag

SEQ ID NO: 68828 - DNA, 18 bp, Artificial Sequence
  Synthetic DNA
tcatacgtaacactacag

SEQ ID NO: 68829 - DNA, 18 bp, Artificial Sequence
  Synthetic DNA
tcatacgtatcgccatag

SEQ ID NO: 68830 - DNA, 18 bp, Artificial Sequence
  Synthetic DNA
tcatacgtctcatttacg

SEQ ID NO: 68831 - DNA, 18 bp, Artificial Sequence
  Synthetic DNA
tcatacttatgaatattg

SEQ ID NO: 68832 - DNA, 18 bp, Artificial Sequence
  Synthetic DNA
tcatagcgatcactttag

SEQ ID NO: 68833 - DNA, 18 bp, Artificial Sequence
  Synthetic DNA
tcataggactttctttgg

SEQ ID NO: 68834 - DNA, 18 bp, Artificial Sequence
  Synthetic DNA
tcatataactaactattg

SEQ ID NO: 68835 - DNA, 18 bp, Artificial Sequence
  Synthetic DNA
tcatatgacaaactattg

SEQ ID NO: 68836 - DNA, 18 bp, Artificial Sequence
  Synthetic DNA
tcatatgtctctccatag

SEQ ID NO: 68837 - DNA, 18 bp, Artificial Sequence
  Synthetic DNA
tcatatgtctttctgcag

SEQ ID NO: 68838 - DNA, 18 bp, Artificial Sequence
  Synthetic DNA
tcatcattctttctattg

SEQ ID NO: 68839 - DNA, 18 bp, Artificial Sequence
  Synthetic DNA
tcatccaattctctatag

SEQ ID NO: 68840 - DNA, 18 bp, Artificial Sequence
  Synthetic DNA
tcatccgtctacctgcag

SEQ ID NO: 68841 - DNA, 18 bp, Artificial Sequence
  Synthetic DNA
tcatctaaatcactaaag

SEQ ID NO: 68842 - DNA, 18 bp, Artificial Sequence
  Synthetic DNA
tcatgagattcacgagag

SEQ ID NO: 68843 - DNA, 18 bp, Artificial Sequence
  Synthetic DNA
tcatgcaactcactgaag

SEQ ID NO: 68844 - DNA, 18 bp, Artificial Sequence
  Synthetic DNA
tcattcaacacactatgg

SEQ ID NO: 68845 - DNA, 18 bp, Artificial Sequence
  Synthetic DNA
tcattcgacaccccattg

SEQ ID NO: 68846 - DNA, 18 bp, Artificial Sequence
  Synthetic DNA
tcattcgactatcgatag

SEQ ID NO: 68847 - DNA, 18 bp, Artificial Sequence
  Synthetic DNA
tcattcgactctcagttg

SEQ ID NO: 68848 - DNA, 18 bp, Artificial Sequence
  Synthetic DNA
tcattctacacaccatag

SEQ ID NO: 68849 - DNA, 18 bp, Artificial Sequence
  Synthetic DNA
tcattgcactctctcttg

SEQ ID NO: 68850 - DNA, 18 bp, Artificial Sequence
  Synthetic DNA
tcatttgactcaatatcg

SEQ ID NO: 68851 - DNA, 18 bp, Artificial Sequence
  Synthetic DNA
tcatttgactttctatgg

SEQ ID NO: 68852 - DNA, 18 bp, Artificial Sequence
  Synthetic DNA
tcccacgattaattatag

SEQ ID NO: 68853 - DNA, 18 bp, Artificial Sequence
  Synthetic DNA
tcctccgactaaccatag

SEQ ID NO: 68854 - DNA, 18 bp, Artificial Sequence
  Synthetic DNA
tcgtatgacgaaatatag

SEQ ID NO: 68855 - DNA, 18 bp, Artificial Sequence
  Synthetic DNA
tctaacctttcacaattg

SEQ ID NO: 68856 - DNA, 18 bp, Artificial Sequence
  Synthetic DNA
tctaacgactgtaattag

SEQ ID NO: 68857 - DNA, 18 bp, Artificial Sequence
  Synthetic DNA
tctatggactcactatag

SEQ ID NO: 68858 - DNA, 18 bp, Artificial Sequence
  Synthetic DNA
tctcacggctaacacttg

SEQ ID NO: 68859 - DNA, 18 bp, Artificial Sequence
  Synthetic DNA
tctgacgacacaccgttg

SEQ ID NO: 68860 - DNA, 18 bp, Artificial Sequence
  Synthetic DNA
tcttacaacaaactatag

SEQ ID NO: 68861 - DNA, 18 bp, Artificial Sequence
  Synthetic DNA
tcttacccttgagtattg

SEQ ID NO: 68862 - DNA, 18 bp, Artificial Sequence
  Synthetic DNA
tcttacgactcaccaacg

SEQ ID NO: 68863 - DNA, 18 bp, Artificial Sequence
  Synthetic DNA
tcttacgacttacttaag

SEQ ID NO: 68864 - DNA, 18 bp, Artificial Sequence
  Synthetic DNA
tcttacgacttcctttag

SEQ ID NO: 68865 - DNA, 18 bp, Artificial Sequence
  Synthetic DNA
tcttacgtctcgctaagg

SEQ ID NO: 68866 - DNA, 18 bp, Artificial Sequence
  Synthetic DNA
tctttccacacaccagtg

SEQ ID NO: 68867 - DNA, 18 bp, Artificial Sequence
  Synthetic DNA
tgaaaccacagactatgg

SEQ ID NO: 68868 - DNA, 18 bp, Artificial Sequence
  Synthetic DNA
tgaaacgaaacacgacag

SEQ ID NO: 68869 - DNA, 18 bp, Artificial Sequence
  Synthetic DNA
tgaaacgccaccctagag

SEQ ID NO: 68870 - DNA, 18 bp, Artificial Sequence
  Synthetic DNA
tgaaacgtctctctttag

SEQ ID NO: 68871 - DNA, 18 bp, Artificial Sequence
  Synthetic DNA
tgaaacgtcttaccttag

SEQ ID NO: 68872 - DNA, 18 bp, Artificial Sequence
  Synthetic DNA
tgaaccgacgcactatcg

SEQ ID NO: 68873 - DNA, 18 bp, Artificial Sequence
  Synthetic DNA
tgaacttatccacgttag

SEQ ID NO: 68874 - DNA, 18 bp, Artificial Sequence
  Synthetic DNA
tgacacgtctcatgatag

SEQ ID NO: 68875 - DNA, 18 bp, Artificial Sequence
  Synthetic DNA
tgacgagtctcatcttag

SEQ ID NO: 68876 - DNA, 18 bp, Artificial Sequence
  Synthetic DNA
tgagacctctcattatag

SEQ ID NO: 68877 - DNA, 18 bp, Artificial Sequence
  Synthetic DNA
tgagaggactcacgaacg

SEQ ID NO: 68878 - DNA, 18 bp, Artificial Sequence
  Synthetic DNA
tgataagccacaccatag

SEQ ID NO: 68879 - DNA, 18 bp, Artificial Sequence
  Synthetic DNA
tgatacaactcagtcgag

SEQ ID NO: 68880 - DNA, 18 bp, Artificial Sequence
  Synthetic DNA
tgatacatctcgctaatg

SEQ ID NO: 68881 - DNA, 18 bp, Artificial Sequence
  Synthetic DNA
tgatacatttcgcttaag

SEQ ID NO: 68882 - DNA, 18 bp, Artificial Sequence
  Synthetic DNA
tgataccacactttatag

SEQ ID NO: 68883 - DNA, 18 bp, Artificial Sequence
  Synthetic DNA
tgataccactctgcgaag

SEQ ID NO: 68884 - DNA, 18 bp, Artificial Sequence
  Synthetic DNA
tgatacgactcacatatg

SEQ ID NO: 68885 - DNA, 18 bp, Artificial Sequence
  Synthetic DNA
tgatacgactcatagaag

SEQ ID NO: 68886 - DNA, 18 bp, Artificial Sequence
  Synthetic DNA
tgatacgactcatgcgag

SEQ ID NO: 68887 - DNA, 18 bp, Artificial Sequence
  Synthetic DNA
tgatacgattcccaatcg

SEQ ID NO: 68888 - DNA, 18 bp, Artificial Sequence
  Synthetic DNA
tgatacgcctctccatgg

SEQ ID NO: 68889 - DNA, 18 bp, Artificial Sequence
  Synthetic DNA
tgatacgcctctgtacag

SEQ ID NO: 68890 - DNA, 18 bp, Artificial Sequence
  Synthetic DNA
tgatactactttcgatag

SEQ ID NO: 68891 - DNA, 18 bp, Artificial Sequence
  Synthetic DNA
tgataggccttactttag

SEQ ID NO: 68892 - DNA, 18 bp, Artificial Sequence
  Synthetic DNA
tgatagttctccctattg

SEQ ID NO: 68893 - DNA, 18 bp, Artificial Sequence
  Synthetic DNA
tgatatgtctcgcaatag

SEQ ID NO: 68894 - DNA, 18 bp, Artificial Sequence
  Synthetic DNA
tgatattaatcactaggg

SEQ ID NO: 68895 - DNA, 18 bp, Artificial Sequence
  Synthetic DNA
tgatatttgtcactatag

SEQ ID NO: 68896 - DNA, 18 bp, Artificial Sequence
  Synthetic DNA
tgatcagacttactaata

SEQ ID NO: 68897 - DNA, 18 bp, Artificial Sequence
  Synthetic DNA
tgattagtctaactattg

SEQ ID NO: 68898 - DNA, 18 bp, Artificial Sequence
  Synthetic DNA
tgattcaactcacttgtg

SEQ ID NO: 68899 - DNA, 18 bp, Artificial Sequence
  Synthetic DNA
tgattcaactcgttattg

SEQ ID NO: 68900 - DNA, 18 bp, Artificial Sequence
  Synthetic DNA
tgattccactcgctcttg

SEQ ID NO: 68901 - DNA, 18 bp, Artificial Sequence
  Synthetic DNA
tgattcgacaaactacag

SEQ ID NO: 68902 - DNA, 18 bp, Artificial Sequence
  Synthetic DNA
tgattcgactctttctag

SEQ ID NO: 68903 - DNA, 18 bp, Artificial Sequence
  Synthetic DNA
tgattcgcttctccaaag

SEQ ID NO: 68904 - DNA, 18 bp, Artificial Sequence
  Synthetic DNA
tgattcgcttcttgatag

SEQ ID NO: 68905 - DNA, 18 bp, Artificial Sequence
  Synthetic DNA
tgattcgtcattcaatag

SEQ ID NO: 68906 - DNA, 18 bp, Artificial Sequence
  Synthetic DNA
tgattcgtctcaatattg

SEQ ID NO: 68907 - DNA, 18 bp, Artificial Sequence
  Synthetic DNA
tgattctaatccctatag

SEQ ID NO: 68908 - DNA, 18 bp, Artificial Sequence
  Synthetic DNA
tgcaacgacttacaatag

SEQ ID NO: 68909 - DNA, 18 bp, Artificial Sequence
  Synthetic DNA
tgctacaactcagtaacg

SEQ ID NO: 68910 - DNA, 18 bp, Artificial Sequence
  Synthetic DNA
tggttcaacatactatag

SEQ ID NO: 68911 - DNA, 18 bp, Artificial Sequence
  Synthetic DNA
tgtaacgacttacttcag

SEQ ID NO: 68912 - DNA, 18 bp, Artificial Sequence
  Synthetic DNA
tgtaactactctgcatag

SEQ ID NO: 68913 - DNA, 18 bp, Artificial Sequence
  Synthetic DNA
tgttacgaaacattattg

SEQ ID NO: 68914 - DNA, 18 bp, Artificial Sequence
  Synthetic DNA
tgttacgacacatttatg

SEQ ID NO: 68915 - DNA, 18 bp, Artificial Sequence
  Synthetic DNA
tgttacgactaaccagag

SEQ ID NO: 68916 - DNA, 18 bp, Artificial Sequence
  Synthetic DNA
tgttacgactcagttaag

SEQ ID NO: 68917 - DNA, 18 bp, Artificial Sequence
  Synthetic DNA
tgttacgatcctatatag

SEQ ID NO: 68918 - DNA, 18 bp, Artificial Sequence
  Synthetic DNA
tgttacgccttacttttg

SEQ ID NO: 68919 - DNA, 18 bp, Artificial Sequence
  Synthetic DNA
tgttacgcctttctatag

SEQ ID NO: 68920 - DNA, 18 bp, Artificial Sequence
  Synthetic DNA
tgttacggcttaatacag

SEQ ID NO: 68921 - DNA, 18 bp, Artificial Sequence
  Synthetic DNA
tgttacgtccctttaatg

SEQ ID NO: 68922 - DNA, 18 bp, Artificial Sequence
  Synthetic DNA
tgttacgtctcaccatcg

SEQ ID NO: 68923 - DNA, 18 bp, Artificial Sequence
  Synthetic DNA
tgttacgtctgactgtag

SEQ ID NO: 68924 - DNA, 18 bp, Artificial Sequence
  Synthetic DNA
tgttactactcaatttag

SEQ ID NO: 68925 - DNA, 18 bp, Artificial Sequence
  Synthetic DNA
tgttactccacactattg

SEQ ID NO: 68926 - DNA, 18 bp, Artificial Sequence
  Synthetic DNA
tgttccgtctccctatcg

SEQ ID NO: 68927 - DNA, 18 bp, Artificial Sequence
  Synthetic DNA
ttaaaatactcactgtag

SEQ ID NO: 68928 - DNA, 18 bp, Artificial Sequence
  Synthetic DNA
ttaaacaactcactactg

SEQ ID NO: 68929 - DNA, 18 bp, Artificial Sequence
  Synthetic DNA
ttaaacgaaacactgtgg

SEQ ID NO: 68930 - DNA, 18 bp, Artificial Sequence
  Synthetic DNA
ttaaacgaatcattatgg

SEQ ID NO: 68931 - DNA, 18 bp, Artificial Sequence
  Synthetic DNA
ttaaacgactgaccttag

SEQ ID NO: 68932 - DNA, 18 bp, Artificial Sequence
  Synthetic DNA
ttaaactactacctatag

SEQ ID NO: 68933 - DNA, 18 bp, Artificial Sequence
  Synthetic DNA
ttaaactattcgcactag

SEQ ID NO: 68934 - DNA, 18 bp, Artificial Sequence
  Synthetic DNA
ttaaagcactcacctttg

SEQ ID NO: 68935 - DNA, 18 bp, Artificial Sequence
  Synthetic DNA
ttaaaggactcattaaag

SEQ ID NO: 68936 - DNA, 18 bp, Artificial Sequence
  Synthetic DNA
ttaaagggcatactttag

SEQ ID NO: 68937 - DNA, 18 bp, Artificial Sequence
  Synthetic DNA
ttaaatgactcacaatgg

SEQ ID NO: 68938 - DNA, 18 bp, Artificial Sequence
  Synthetic DNA
ttaaatgactcacttcgg

SEQ ID NO: 68939 - DNA, 18 bp, Artificial Sequence
  Synthetic DNA
ttaaatgtctcactaggg

SEQ ID NO: 68940 - DNA, 18 bp, Artificial Sequence
  Synthetic DNA
ttaaatgtctcactgtag

SEQ ID NO: 68941 - DNA, 18 bp, Artificial Sequence
  Synthetic DNA
ttaagggacaaactattg

SEQ ID NO: 68942 - DNA, 18 bp, Artificial Sequence
  Synthetic DNA
ttaatcgactcacaacag

SEQ ID NO: 68943 - DNA, 18 bp, Artificial Sequence
  Synthetic DNA
ttaatcgtctcaccatag

SEQ ID NO: 68944 - DNA, 18 bp, Artificial Sequence
  Synthetic DNA
ttaatctactccctacag

SEQ ID NO: 68945 - DNA, 18 bp, Artificial Sequence
  Synthetic DNA
ttacaccaatctctaatg

SEQ ID NO: 68946 - DNA, 18 bp, Artificial Sequence
  Synthetic DNA
ttacacgcaccacaatag

SEQ ID NO: 68947 - DNA, 18 bp, Artificial Sequence
  Synthetic DNA
ttacacgcctccctaaag

SEQ ID NO: 68948 - DNA, 18 bp, Artificial Sequence
  Synthetic DNA
ttacactactcatgatag

SEQ ID NO: 68949 - DNA, 18 bp, Artificial Sequence
  Synthetic DNA
ttacactattctttatag

SEQ ID NO: 68950 - DNA, 18 bp, Artificial Sequence
  Synthetic DNA
ttacatgactctcaatag

SEQ ID NO: 68951 - DNA, 18 bp, Artificial Sequence
  Synthetic DNA
ttacccgattcaatattg

SEQ ID NO: 68952 - DNA, 18 bp, Artificial Sequence
  Synthetic DNA
ttacgcctaactctattg

SEQ ID NO: 68953 - DNA, 18 bp, Artificial Sequence
  Synthetic DNA
ttactcgaattacttcag

SEQ ID NO: 68954 - DNA, 18 bp, Artificial Sequence
  Synthetic DNA
ttactcgacttaccatag

SEQ ID NO: 68955 - DNA, 18 bp, Artificial Sequence
  Synthetic DNA
ttagactacacaccatag

SEQ ID NO: 68956 - DNA, 18 bp, Artificial Sequence
  Synthetic DNA
ttataacacacaccttag

SEQ ID NO: 68957 - DNA, 18 bp, Artificial Sequence
  Synthetic DNA
ttataagaataacaaaag

SEQ ID NO: 68958 - DNA, 18 bp, Artificial Sequence
  Synthetic DNA
ttataagactcactcagg

SEQ ID NO: 68959 - DNA, 18 bp, Artificial Sequence
  Synthetic DNA
ttataagactcccattag

SEQ ID NO: 68960 - DNA, 18 bp, Artificial Sequence
  Synthetic DNA
ttataagattcacaattg

SEQ ID NO: 68961 - DNA, 18 bp, Artificial Sequence
  Synthetic DNA
ttataatacacgctatag

SEQ ID NO: 68962 - DNA, 18 bp, Artificial Sequence
  Synthetic DNA
ttatacaaatcactaacg

SEQ ID NO: 68963 - DNA, 18 bp, Artificial Sequence
  Synthetic DNA
ttatacaactctttcaag

SEQ ID NO: 68964 - DNA, 18 bp, Artificial Sequence
  Synthetic DNA
ttatacaactttaaatgg

SEQ ID NO: 68965 - DNA, 18 bp, Artificial Sequence
  Synthetic DNA
ttatacaagcccatttag

SEQ ID NO: 68966 - DNA, 18 bp, Artificial Sequence
  Synthetic DNA
ttatacaatttcctatag

SEQ ID NO: 68967 - DNA, 18 bp, Artificial Sequence
  Synthetic DNA
ttatacatctcattcttg

SEQ ID NO: 68968 - DNA, 18 bp, Artificial Sequence
  Synthetic DNA
ttataccatacactattg

SEQ ID NO: 68969 - DNA, 18 bp, Artificial Sequence
  Synthetic DNA
ttataccatactcaatag

SEQ ID NO: 68970 - DNA, 18 bp, Artificial Sequence
  Synthetic DNA
ttatacccctctctgtag

SEQ ID NO: 68971 - DNA, 18 bp, Artificial Sequence
  Synthetic DNA
ttatacgaatatctaatg

SEQ ID NO: 68972 - DNA, 18 bp, Artificial Sequence
  Synthetic DNA
ttatacgacacatttttg

SEQ ID NO: 68973 - DNA, 18 bp, Artificial Sequence
  Synthetic DNA
ttatacgacccacaaatg

SEQ ID NO: 68974 - DNA, 18 bp, Artificial Sequence
  Synthetic DNA
ttatacgactcccttacg

SEQ ID NO: 68975 - DNA, 18 bp, Artificial Sequence
  Synthetic DNA
ttatacgacttaacttag

SEQ ID NO: 68976 - DNA, 18 bp, Artificial Sequence
  Synthetic DNA
ttatacgagccaaacaag

SEQ ID NO: 68977 - DNA, 18 bp, Artificial Sequence
  Synthetic DNA
ttatacgatatactttag

SEQ ID NO: 68978 - DNA, 18 bp, Artificial Sequence
  Synthetic DNA
ttatacgatttacatttg

SEQ ID NO: 68979 - DNA, 18 bp, Artificial Sequence
  Synthetic DNA
ttatacgccacacattag

SEQ ID NO: 68980 - DNA, 18 bp, Artificial Sequence
  Synthetic DNA
ttatacgcgcctaactag

SEQ ID NO: 68981 - DNA, 18 bp, Artificial Sequence
  Synthetic DNA
ttatacgtatcatcaaag

SEQ ID NO: 68982 - DNA, 18 bp, Artificial Sequence
  Synthetic DNA
ttatacgtcaagcaatag

SEQ ID NO: 68983 - DNA, 18 bp, Artificial Sequence
  Synthetic DNA
ttatacgtcactccactg

SEQ ID NO: 68984 - DNA, 18 bp, Artificial Sequence
  Synthetic DNA
ttatacgtcgccctttag

SEQ ID NO: 68985 - DNA, 18 bp, Artificial Sequence
  Synthetic DNA
ttatacgtctatcaattg

SEQ ID NO: 68986 - DNA, 18 bp, Artificial Sequence
  Synthetic DNA
ttatacgtctctttaaag

SEQ ID NO: 68987 - DNA, 18 bp, Artificial Sequence
  Synthetic DNA
ttatacgtctttataaag

SEQ ID NO: 68988 - DNA, 18 bp, Artificial Sequence
  Synthetic DNA
ttatactaatctctctag

SEQ ID NO: 68989 - DNA, 18 bp, Artificial Sequence
  Synthetic DNA
ttatactacccattctag

SEQ ID NO: 68990 - DNA, 18 bp, Artificial Sequence
  Synthetic DNA
ttatactacttaccaatg

SEQ ID NO: 68991 - DNA, 18 bp, Artificial Sequence
  Synthetic DNA
ttatactacttacgattg

SEQ ID NO: 68992 - DNA, 18 bp, Artificial Sequence
  Synthetic DNA
ttatactacttcatcttg

SEQ ID NO: 68993 - DNA, 18 bp, Artificial Sequence
  Synthetic DNA
ttatacttctcaccatcg

SEQ ID NO: 68994 - DNA, 18 bp, Artificial Sequence
  Synthetic DNA
ttataggtctaacaacag

SEQ ID NO: 68995 - DNA, 18 bp, Artificial Sequence
  Synthetic DNA
ttataggtctcattttag

SEQ ID NO: 68996 - DNA, 18 bp, Artificial Sequence
  Synthetic DNA
ttataggtctgagcattg

SEQ ID NO: 68997 - DNA, 18 bp, Artificial Sequence
  Synthetic DNA
ttatagttctcactttcg

SEQ ID NO: 68998 - DNA, 18 bp, Artificial Sequence
  Synthetic DNA
ttatatcactcactaatg

SEQ ID NO: 68999 - DNA, 18 bp, Artificial Sequence
  Synthetic DNA
ttatatctcacactaaag

SEQ ID NO: 69000 - DNA, 18 bp, Artificial Sequence
  Synthetic DNA
ttatatgacacatcatag

SEQ ID NO: 69001 - DNA, 18 bp, Artificial Sequence
  Synthetic DNA
ttatatgacagtctatag

SEQ ID NO: 69002 - DNA, 18 bp, Artificial Sequence
  Synthetic DNA
ttatatgacatactttag

SEQ ID NO: 69003 - DNA, 18 bp, Artificial Sequence
  Synthetic DNA
ttatatgactaattcaag

SEQ ID NO: 69004 - DNA, 18 bp, Artificial Sequence
  Synthetic DNA
ttatatggctcataatag

SEQ ID NO: 69005 - DNA, 18 bp, Artificial Sequence
  Synthetic DNA
ttatatgtctgactacag

SEQ ID NO: 69006 - DNA, 18 bp, Artificial Sequence
  Synthetic DNA
ttatattcatctctatag

SEQ ID NO: 69007 - DNA, 18 bp, Artificial Sequence
  Synthetic DNA
ttatccgaatctctttag

SEQ ID NO: 69008 - DNA, 18 bp, Artificial Sequence
  Synthetic DNA
ttatccgaatgactattg

SEQ ID NO: 69009 - DNA, 18 bp, Artificial Sequence
  Synthetic DNA
ttatccgacacactggtg

SEQ ID NO: 69010 - DNA, 18 bp, Artificial Sequence
  Synthetic DNA
ttatccgactctttttag

SEQ ID NO: 69011 - DNA, 18 bp, Artificial Sequence
  Synthetic DNA
ttatccgactgacgagag

SEQ ID NO: 69012 - DNA, 18 bp, Artificial Sequence
  Synthetic DNA
ttatccgtctcaccgtag

SEQ ID NO: 69013 - DNA, 18 bp, Artificial Sequence
  Synthetic DNA
ttatccgtctctttattg

SEQ ID NO: 69014 - DNA, 18 bp, Artificial Sequence
  Synthetic DNA
ttatctgactcacgttcg

SEQ ID NO: 69015 - DNA, 18 bp, Artificial Sequence
  Synthetic DNA
ttatgagactcaccgtag

SEQ ID NO: 69016 - DNA, 18 bp, Artificial Sequence
  Synthetic DNA
ttatgcaagtgacaatag

SEQ ID NO: 69017 - DNA, 18 bp, Artificial Sequence
  Synthetic DNA
ttatgcatctcactaaag

SEQ ID NO: 69018 - DNA, 18 bp, Artificial Sequence
  Synthetic DNA
ttatgcgactttctaatg

SEQ ID NO: 69019 - DNA, 18 bp, Artificial Sequence
  Synthetic DNA
ttatgcgtctccctttcg

SEQ ID NO: 69020 - DNA, 18 bp, Artificial Sequence
  Synthetic DNA
ttatgcgtttcactattg

SEQ ID NO: 69021 - DNA, 18 bp, Artificial Sequence
  Synthetic DNA
ttatgtaaccaagtatag

SEQ ID NO: 69022 - DNA, 18 bp, Artificial Sequence
  Synthetic DNA
ttatgtgacacaatgtgg

SEQ ID NO: 69023 - DNA, 18 bp, Artificial Sequence
  Synthetic DNA
ttatgttacacattattg

SEQ ID NO: 69024 - DNA, 18 bp, Artificial Sequence
  Synthetic DNA
ttattacatcacctatag

SEQ ID NO: 69025 - DNA, 18 bp, Artificial Sequence
  Synthetic DNA
ttattcaacactctatag

SEQ ID NO: 69026 - DNA, 18 bp, Artificial Sequence
  Synthetic DNA
ttattcaacactcttttg

SEQ ID NO: 69027 - DNA, 18 bp, Artificial Sequence
  Synthetic DNA
ttattcaattcgccaaag

SEQ ID NO: 69028 - DNA, 18 bp, Artificial Sequence
  Synthetic DNA
ttattcatccctctatag

SEQ ID NO: 69029 - DNA, 18 bp, Artificial Sequence
  Synthetic DNA
ttattcctctccctatag

SEQ ID NO: 69030 - DNA, 18 bp, Artificial Sequence
  Synthetic DNA
ttattcgactccgtgtag

SEQ ID NO: 69031 - DNA, 18 bp, Artificial Sequence
  Synthetic DNA
ttattcgactctccttag

SEQ ID NO: 69032 - DNA, 18 bp, Artificial Sequence
  Synthetic DNA
ttattcgagtcagacttg

SEQ ID NO: 69033 - DNA, 18 bp, Artificial Sequence
  Synthetic DNA
ttattcggcttactatcg

SEQ ID NO: 69034 - DNA, 18 bp, Artificial Sequence
  Synthetic DNA
ttattctaattactatag

SEQ ID NO: 69035 - DNA, 18 bp, Artificial Sequence
  Synthetic DNA
ttattctatcaagttcag

SEQ ID NO: 69036 - DNA, 18 bp, Artificial Sequence
  Synthetic DNA
ttattctcttcactgtcg

SEQ ID NO: 69037 - DNA, 18 bp, Artificial Sequence
  Synthetic DNA
ttattcttctcactcatg

SEQ ID NO: 69038 - DNA, 18 bp, Artificial Sequence
  Synthetic DNA
ttattcttctctctagcg

SEQ ID NO: 69039 - DNA, 18 bp, Artificial Sequence
  Synthetic DNA
ttatttaattcactatag

SEQ ID NO: 69040 - DNA, 18 bp, Artificial Sequence
  Synthetic DNA
ttatttatctcactatag

SEQ ID NO: 69041 - DNA, 18 bp, Artificial Sequence
  Synthetic DNA
ttatttgattcactgtag

SEQ ID NO: 69042 - DNA, 18 bp, Artificial Sequence
  Synthetic DNA
ttcaacgtatcacactag

SEQ ID NO: 69043 - DNA, 18 bp, Artificial Sequence
  Synthetic DNA
ttcaatgtaacactatag

SEQ ID NO: 69044 - DNA, 18 bp, Artificial Sequence
  Synthetic DNA
ttcagctaatcactatag

SEQ ID NO: 69045 - DNA, 18 bp, Artificial Sequence
  Synthetic DNA
ttctaaggctgactatag

SEQ ID NO: 69046 - DNA, 18 bp, Artificial Sequence
  Synthetic DNA
ttctagcactaacaatag

SEQ ID NO: 69047 - DNA, 18 bp, Artificial Sequence
  Synthetic DNA
ttgaacaactcactatgg

SEQ ID NO: 69048 - DNA, 18 bp, Artificial Sequence
  Synthetic DNA
ttgcacaacactctctag

SEQ ID NO: 69049 - DNA, 18 bp, Artificial Sequence
  Synthetic DNA
ttgtacaactgactttag

SEQ ID NO: 69050 - DNA, 18 bp, Artificial Sequence
  Synthetic DNA
ttgtacgactctaactag

SEQ ID NO: 69051 - DNA, 18 bp, Artificial Sequence
  Synthetic DNA
ttgtatcactcaatatag

SEQ ID NO: 69052 - DNA, 18 bp, Artificial Sequence
  Synthetic DNA
ttgtgcgagtcactttgg

SEQ ID NO: 69053 - DNA, 18 bp, Artificial Sequence
  Synthetic DNA
ttgttcccatatctatag

SEQ ID NO: 69054 - DNA, 18 bp, Artificial Sequence
  Synthetic DNA
ttgtttgactcacaatag

SEQ ID NO: 69055 - DNA, 18 bp, Artificial Sequence
  Synthetic DNA
tttaacgtcttccaatag

SEQ ID NO: 69056 - DNA, 18 bp, Artificial Sequence
  Synthetic DNA
tttagtgacttactatag

SEQ ID NO: 69057 - DNA, 18 bp, Artificial Sequence
  Synthetic DNA
tttcttgactaactaaag

SEQ ID NO: 69058 - DNA, 18 bp, Artificial Sequence
  Synthetic DNA
ttttaagactcactaacg

SEQ ID NO: 69059 - DNA, 18 bp, Artificial Sequence
  Synthetic DNA
ttttaagtctcacttcag

SEQ ID NO: 69060 - DNA, 18 bp, Artificial Sequence
  Synthetic DNA
ttttacaactcgctatcg

SEQ ID NO: 69061 - DNA, 18 bp, Artificial Sequence
  Synthetic DNA
ttttacaattcacttatg

SEQ ID NO: 69062 - DNA, 18 bp, Artificial Sequence
  Synthetic DNA
ttttacgaatctgtaaag

SEQ ID NO: 69063 - DNA, 18 bp, Artificial Sequence
  Synthetic DNA
ttttacgacatactttag

SEQ ID NO: 69064 - DNA, 18 bp, Artificial Sequence
  Synthetic DNA
ttttacgacgcagtattg

SEQ ID NO: 69065 - DNA, 18 bp, Artificial Sequence
  Synthetic DNA
ttttacgactcatttttg

SEQ ID NO: 69066 - DNA, 18 bp, Artificial Sequence
  Synthetic DNA
ttttacgtctctctatcg

SEQ ID NO: 69067 - DNA, 18 bp, Artificial Sequence
  Synthetic DNA
ttttactacctactatag

SEQ ID NO: 69068 - DNA, 18 bp, Artificial Sequence
  Synthetic DNA
ttttactactctctagag

SEQ ID NO: 69069 - DNA, 18 bp, Artificial Sequence
  Synthetic DNA
ttttactactttccatag

SEQ ID NO: 69070 - DNA, 18 bp, Artificial Sequence
  Synthetic DNA
ttttaggagtcgttattg

SEQ ID NO: 69071 - DNA, 18 bp, Artificial Sequence
  Synthetic DNA
ttttatgtcttactatag

SEQ ID NO: 69072 - DNA, 18 bp, Artificial Sequence
  Synthetic DNA
ttttgcgattgacaacag

SEQ ID NO: 69073 - DNA, 18 bp, Artificial Sequence
  Synthetic DNA
ttttgggattgagtctag

SEQ ID NO: 69074 - DNA, 18 bp, Artificial Sequence
  Synthetic DNA
tttttagactctctatag

SEQ ID NO: 69075 - DNA, 18 bp, Artificial Sequence
  Synthetic DNA
tttttagattcactatag

SEQ ID NO: 69076 - DNA, 18 bp, Artificial Sequence
  Synthetic DNA
tttttagtctcactatgg

SEQ ID NO: 69077 - DNA, 18 bp, Artificial Sequence
  Synthetic DNA
tttttcaactcaataaag

SEQ ID NO: 69078 - DNA, 18 bp, Artificial Sequence
  Synthetic DNA
aaacacgactctcaattg

SEQ ID NO: 69079 - DNA, 18 bp, Artificial Sequence
  Synthetic DNA
aaatacgtatcactgttg

SEQ ID NO: 69080 - DNA, 18 bp, Artificial Sequence
  Synthetic DNA
taatacctatcattatcg

SEQ ID NO: 69081 - DNA, 18 bp, Artificial Sequence
  Synthetic DNA
taattcttctcacagtag

SEQ ID NO: 69082 - DNA, 18 bp, Artificial Sequence
  Synthetic DNA
tatatcgacacactattg

SEQ ID NO: 69083 - DNA, 18 bp, Artificial Sequence
  Synthetic DNA
tatctcaactgcctatag

SEQ ID NO: 69084 - DNA, 18 bp, Artificial Sequence
  Synthetic DNA
tattacgtttcaaaatag

SEQ ID NO: 69085 - DNA, 18 bp, Artificial Sequence
  Synthetic DNA
tatttcaactctcaatag

SEQ ID NO: 69086 - DNA, 18 bp, Artificial Sequence
  Synthetic DNA
tatttcggcacaccattg

SEQ ID NO: 69087 - DNA, 18 bp, Artificial Sequence
  Synthetic DNA
tcatacgtcatactattg

SEQ ID NO: 69088 - DNA, 18 bp, Artificial Sequence
  Synthetic DNA
ttatacttcactctaaag

SEQ ID NO: 69089 - DNA, 18 bp, Artificial Sequence
  Synthetic DNA
ttataggactttccatag

SEQ ID NO: 69090 - DNA, 18 bp, Artificial Sequence
  Synthetic DNA
ttttctgtctcactatag

SEQ ID NO: 69091 - DNA, 18 bp, Artificial Sequence
  Synthetic DNA
ttaatctactcactttag

SEQ ID NO: 69092 - DNA, 18 bp, Artificial Sequence
  Synthetic DNA
aaatacgtcacaccaaag

SEQ ID NO: 69093 - DNA, 18 bp, Artificial Sequence
  Synthetic DNA
aattacgttacactatag

SEQ ID NO: 69094 - DNA, 18 bp, Artificial Sequence
  Synthetic DNA
aattacttctctctatag

SEQ ID NO: 69095 - DNA, 18 bp, Artificial Sequence
  Synthetic DNA
atatacgactctttaaag

SEQ ID NO: 69096 - DNA, 18 bp, Artificial Sequence
  Synthetic DNA
ctcatcgactaagtctag

SEQ ID NO: 69097 - DNA, 18 bp, Artificial Sequence
  Synthetic DNA
taaaaaaattcactaaag

SEQ ID NO: 69098 - DNA, 18 bp, Artificial Sequence
  Synthetic DNA
taacccaactctcaatgg

SEQ ID NO: 69099 - DNA, 18 bp, Artificial Sequence
  Synthetic DNA
tattacttatctctatag

SEQ ID NO: 69100 - DNA, 18 bp, Artificial Sequence
  Synthetic DNA
tcatacgacattctatcg

SEQ ID NO: 69101 - DNA, 18 bp, Artificial Sequence
  Synthetic DNA
ttacatgactcacaattg

SEQ ID NO: 69102 - DNA, 18 bp, Artificial Sequence
  Synthetic DNA
ttatacgactttcttaag

SEQ ID NO: 69103 - DNA, 18 bp, Artificial Sequence
  Synthetic DNA
ttatacttctccatatag

SEQ ID NO: 69104 - DNA, 18 bp, Artificial Sequence
  Synthetic DNA
ttattcgtctctctttag

SEQ ID NO: 69105 - DNA, 18 bp, Artificial Sequence
  Synthetic DNA
ttattcttctctctatag

SEQ ID NO: 69106 - DNA, 18 bp, Artificial Sequence
  Synthetic DNA
ttttacgactcgcattag

SEQ ID NO: 69107 - DNA, 18 bp, Artificial Sequence
  Synthetic DNA
aaaaaagactcactcttg

SEQ ID NO: 69108 - DNA, 18 bp, Artificial Sequence
  Synthetic DNA
aaaaaccgctcaataaag

SEQ ID NO: 69109 - DNA, 18 bp, Artificial Sequence
  Synthetic DNA
aaaaacgacactttatag

SEQ ID NO: 69110 - DNA, 18 bp, Artificial Sequence
  Synthetic DNA
aaaaacgtcccacaacag

SEQ ID NO: 69111 - DNA, 18 bp, Artificial Sequence
  Synthetic DNA
aaaaccgactcgctacag

SEQ ID NO: 69112 - DNA, 18 bp, Artificial Sequence
  Synthetic DNA
aaaatcgactgtcaatag

SEQ ID NO: 69113 - DNA, 18 bp, Artificial Sequence
  Synthetic DNA
aaaattgactcactaaag

SEQ ID NO: 69114 - DNA, 18 bp, Artificial Sequence
  Synthetic DNA
aaacacgcattcatatag

SEQ ID NO: 69115 - DNA, 18 bp, Artificial Sequence
  Synthetic DNA
aaacacgtctcacttttg

SEQ ID NO: 69116 - DNA, 18 bp, Artificial Sequence
  Synthetic DNA
aaacactactaactaatg

SEQ ID NO: 69117 - DNA, 18 bp, Artificial Sequence
  Synthetic DNA
aaacagaaatcaccattg

SEQ ID NO: 69118 - DNA, 18 bp, Artificial Sequence
  Synthetic DNA
aaaccctaatcactatag

SEQ ID NO: 69119 - DNA, 18 bp, Artificial Sequence
  Synthetic DNA
aaagacaattcactacag

SEQ ID NO: 69120 - DNA, 18 bp, Artificial Sequence
  Synthetic DNA
aaataacactcacttaag

SEQ ID NO: 69121 - DNA, 18 bp, Artificial Sequence
  Synthetic DNA
aaataactctctctacag

SEQ ID NO: 69122 - DNA, 18 bp, Artificial Sequence
  Synthetic DNA
aaataagaatctcaatag

SEQ ID NO: 69123 - DNA, 18 bp, Artificial Sequence
  Synthetic DNA
aaatacatgtcacaatag

SEQ ID NO: 69124 - DNA, 18 bp, Artificial Sequence
  Synthetic DNA
aaatacgaatcaatactg

SEQ ID NO: 69125 - DNA, 18 bp, Artificial Sequence
  Synthetic DNA
aaatacgactcaaattgg

SEQ ID NO: 69126 - DNA, 18 bp, Artificial Sequence
  Synthetic DNA
aaatacgactcataaatg

SEQ ID NO: 69127 - DNA, 18 bp, Artificial Sequence
  Synthetic DNA
aaatacgactttcagttg

SEQ ID NO: 69128 - DNA, 18 bp, Artificial Sequence
  Synthetic DNA
aaatacgcgccactattg

SEQ ID NO: 69129 - DNA, 18 bp, Artificial Sequence
  Synthetic DNA
aaatacgtctcccaatcg

SEQ ID NO: 69130 - DNA, 18 bp, Artificial Sequence
  Synthetic DNA
aaatactacacactactg

SEQ ID NO: 69131 - DNA, 18 bp, Artificial Sequence
  Synthetic DNA
aaatactattctatatag

SEQ ID NO: 69132 - DNA, 18 bp, Artificial Sequence
  Synthetic DNA
aaatacttctatctaaag

SEQ ID NO: 69133 - DNA, 18 bp, Artificial Sequence
  Synthetic DNA
aaatacttctcattctcg

SEQ ID NO: 69134 - DNA, 18 bp, Artificial Sequence
  Synthetic DNA
aaataggcaacactttag

SEQ ID NO: 69135 - DNA, 18 bp, Artificial Sequence
  Synthetic DNA
aaatatagcccactattg

SEQ ID NO: 69136 - DNA, 18 bp, Artificial Sequence
  Synthetic DNA
aaatatcacgaactttag

SEQ ID NO: 69137 - DNA, 18 bp, Artificial Sequence
  Synthetic DNA
aaatatgacaaaccaatg

SEQ ID NO: 69138 - DNA, 18 bp, Artificial Sequence
  Synthetic DNA
aaatatgacgctttattg

SEQ ID NO: 69139 - DNA, 18 bp, Artificial Sequence
  Synthetic DNA
aaatatgtcgcaaaattg

SEQ ID NO: 69140 - DNA, 18 bp, Artificial Sequence
  Synthetic DNA
aaatcagactatctatag

SEQ ID NO: 69141 - DNA, 18 bp, Artificial Sequence
  Synthetic DNA
aaatcatacttacaaaag

SEQ ID NO: 69142 - DNA, 18 bp, Artificial Sequence
  Synthetic DNA
aaatccaactcaataaag

SEQ ID NO: 69143 - DNA, 18 bp, Artificial Sequence
  Synthetic DNA
aaatcccactcacattag

SEQ ID NO: 69144 - DNA, 18 bp, Artificial Sequence
  Synthetic DNA
aaatccgattcaatttag

SEQ ID NO: 69145 - DNA, 18 bp, Artificial Sequence
  Synthetic DNA
aaatgcgacacactaatg

SEQ ID NO: 69146 - DNA, 18 bp, Artificial Sequence
  Synthetic DNA
aaatgctattcactacag

SEQ ID NO: 69147 - DNA, 18 bp, Artificial Sequence
  Synthetic DNA
aaattcaactcagaaagg

SEQ ID NO: 69148 - DNA, 18 bp, Artificial Sequence
  Synthetic DNA
aaattcgaatcacaaaag

SEQ ID NO: 69149 - DNA, 18 bp, Artificial Sequence
  Synthetic DNA
aaattcgactctccattg

SEQ ID NO: 69150 - DNA, 18 bp, Artificial Sequence
  Synthetic DNA
aaattcgactcttcatag

SEQ ID NO: 69151 - DNA, 18 bp, Artificial Sequence
  Synthetic DNA
aaattcgactctttaaag

SEQ ID NO: 69152 - DNA, 18 bp, Artificial Sequence
  Synthetic DNA
aaattcgagtctctatgg

SEQ ID NO: 69153 - DNA, 18 bp, Artificial Sequence
  Synthetic DNA
aaattcgcctctctatcg

SEQ ID NO: 69154 - DNA, 18 bp, Artificial Sequence
  Synthetic DNA
aaattcgtctgactatcg

SEQ ID NO: 69155 - DNA, 18 bp, Artificial Sequence
  Synthetic DNA
aaattctattcactaaag

SEQ ID NO: 69156 - DNA, 18 bp, Artificial Sequence
  Synthetic DNA
aaatttatcacactatgg

SEQ ID NO: 69157 - DNA, 18 bp, Artificial Sequence
  Synthetic DNA
aacaacaactcactattg

SEQ ID NO: 69158 - DNA, 18 bp, Artificial Sequence
  Synthetic DNA
aacaacagctcacaaaag

SEQ ID NO: 69159 - DNA, 18 bp, Artificial Sequence
  Synthetic DNA
aacaacgtctcacaattg

SEQ ID NO: 69160 - DNA, 18 bp, Artificial Sequence
  Synthetic DNA
aactaagactgactatcg

SEQ ID NO: 69161 - DNA, 18 bp, Artificial Sequence
  Synthetic DNA
aactatgtctccctaaag

SEQ ID NO: 69162 - DNA, 18 bp, Artificial Sequence
  Synthetic DNA
aactccgtctcataatag

SEQ ID NO: 69163 - DNA, 18 bp, Artificial Sequence
  Synthetic DNA
aacttggaataactattg

SEQ ID NO: 69164 - DNA, 18 bp, Artificial Sequence
  Synthetic DNA
aagaaatactcactatag

SEQ ID NO: 69165 - DNA, 18 bp, Artificial Sequence
  Synthetic DNA
aagaacgacaagctatag

SEQ ID NO: 69166 - DNA, 18 bp, Artificial Sequence
  Synthetic DNA
aagcacaactgtctatgg

SEQ ID NO: 69167 - DNA, 18 bp, Artificial Sequence
  Synthetic DNA
aagcacaagacactatag

SEQ ID NO: 69168 - DNA, 18 bp, Artificial Sequence
  Synthetic DNA
aagtacaagatactgaag

SEQ ID NO: 69169 - DNA, 18 bp, Artificial Sequence
  Synthetic DNA
aagtccgactcactcaag

SEQ ID NO: 69170 - DNA, 18 bp, Artificial Sequence
  Synthetic DNA
aagtgcttctctcagtag

SEQ ID NO: 69171 - DNA, 18 bp, Artificial Sequence
  Synthetic DNA
aagttagcttcattattg

SEQ ID NO: 69172 - DNA, 18 bp, Artificial Sequence
  Synthetic DNA
aagttcgactaactattg

SEQ ID NO: 69173 - DNA, 18 bp, Artificial Sequence
  Synthetic DNA
aataacatctcattatcg

SEQ ID NO: 69174 - DNA, 18 bp, Artificial Sequence
  Synthetic DNA
aataacgagtcagcatag

SEQ ID NO: 69175 - DNA, 18 bp, Artificial Sequence
  Synthetic DNA
aataacgattgagaaaag

SEQ ID NO: 69176 - DNA, 18 bp, Artificial Sequence
  Synthetic DNA
aataacgtgtcaaagttg

SEQ ID NO: 69177 - DNA, 18 bp, Artificial Sequence
  Synthetic DNA
aataatgaccggttatag

SEQ ID NO: 69178 - DNA, 18 bp, Artificial Sequence
  Synthetic DNA
aataccgacacattttag

SEQ ID NO: 69179 - DNA, 18 bp, Artificial Sequence
  Synthetic DNA
aatagcgtctcactaaag

SEQ ID NO: 69180 - DNA, 18 bp, Artificial Sequence
  Synthetic DNA
aatatcgactcactctag

SEQ ID NO: 69181 - DNA, 18 bp, Artificial Sequence
  Synthetic DNA
aatcgcgactctctatag

SEQ ID NO: 69182 - DNA, 18 bp, Artificial Sequence
  Synthetic DNA
aatgactaaacactaaag

SEQ ID NO: 69183 - DNA, 18 bp, Artificial Sequence
  Synthetic DNA
aattacgaatcacagtag

SEQ ID NO: 69184 - DNA, 18 bp, Artificial Sequence
  Synthetic DNA
aattacgacactctgtag

SEQ ID NO: 69185 - DNA, 18 bp, Artificial Sequence
  Synthetic DNA
aattacgactaacattag

SEQ ID NO: 69186 - DNA, 18 bp, Artificial Sequence
  Synthetic DNA
aattacgactctcttaag

SEQ ID NO: 69187 - DNA, 18 bp, Artificial Sequence
  Synthetic DNA
aattacgtctcaccattg

SEQ ID NO: 69188 - DNA, 18 bp, Artificial Sequence
  Synthetic DNA
aattaggactaaccatag

SEQ ID NO: 69189 - DNA, 18 bp, Artificial Sequence
  Synthetic DNA
aattaggactctctttag

SEQ ID NO: 69190 - DNA, 18 bp, Artificial Sequence
  Synthetic DNA
aattatgactttctacag

SEQ ID NO: 69191 - DNA, 18 bp, Artificial Sequence
  Synthetic DNA
aattatgtctcacaaaag

SEQ ID NO: 69192 - DNA, 18 bp, Artificial Sequence
  Synthetic DNA
aattattactcattatag

SEQ ID NO: 69193 - DNA, 18 bp, Artificial Sequence
  Synthetic DNA
aatttcaactcacttttg

SEQ ID NO: 69194 - DNA, 18 bp, Artificial Sequence
  Synthetic DNA
aatttccattcattatgg

SEQ ID NO: 69195 - DNA, 18 bp, Artificial Sequence
  Synthetic DNA
aatttcgtcaaacgattg

SEQ ID NO: 69196 - DNA, 18 bp, Artificial Sequence
  Synthetic DNA
acacacgtatcactatag

SEQ ID NO: 69197 - DNA, 18 bp, Artificial Sequence
  Synthetic DNA
acactcttatcactatag

SEQ ID NO: 69198 - DNA, 18 bp, Artificial Sequence
  Synthetic DNA
acatacaacacaccatag

SEQ ID NO: 69199 - DNA, 18 bp, Artificial Sequence
  Synthetic DNA
acatacaacttcctatag

SEQ ID NO: 69200 - DNA, 18 bp, Artificial Sequence
  Synthetic DNA
acatacctttctctatag

SEQ ID NO: 69201 - DNA, 18 bp, Artificial Sequence
  Synthetic DNA
acatgctactcaatattg

SEQ ID NO: 69202 - DNA, 18 bp, Artificial Sequence
  Synthetic DNA
acattagcctcactatag

SEQ ID NO: 69203 - DNA, 18 bp, Artificial Sequence
  Synthetic DNA
acattcgattccattcag

SEQ ID NO: 69204 - DNA, 18 bp, Artificial Sequence
  Synthetic DNA
acttaccactctcaatag

SEQ ID NO: 69205 - DNA, 18 bp, Artificial Sequence
  Synthetic DNA
acttactaaacactttag

SEQ ID NO: 69206 - DNA, 18 bp, Artificial Sequence
  Synthetic DNA
agaaacgactaacgtcag

SEQ ID NO: 69207 - DNA, 18 bp, Artificial Sequence
  Synthetic DNA
agatacaactcacgctag

SEQ ID NO: 69208 - DNA, 18 bp, Artificial Sequence
  Synthetic DNA
agattcggctaattatag

SEQ ID NO: 69209 - DNA, 18 bp, Artificial Sequence
  Synthetic DNA
agctaggaatcaatatag

SEQ ID NO: 69210 - DNA, 18 bp, Artificial Sequence
  Synthetic DNA
aggtaagacactctgtag

SEQ ID NO: 69211 - DNA, 18 bp, Artificial Sequence
  Synthetic DNA
agttacgtctcactggag

SEQ ID NO: 69212 - DNA, 18 bp, Artificial Sequence
  Synthetic DNA
ataaacgactagcaaaag

SEQ ID NO: 69213 - DNA, 18 bp, Artificial Sequence
  Synthetic DNA
ataatacacaaactatag

SEQ ID NO: 69214 - DNA, 18 bp, Artificial Sequence
  Synthetic DNA
ataatcgtctcactattg

SEQ ID NO: 69215 - DNA, 18 bp, Artificial Sequence
  Synthetic DNA
atacacgacacgctaaag

SEQ ID NO: 69216 - DNA, 18 bp, Artificial Sequence
  Synthetic DNA
atataaaactcactttcg

SEQ ID NO: 69217 - DNA, 18 bp, Artificial Sequence
  Synthetic DNA
atataacactcactaacg

SEQ ID NO: 69218 - DNA, 18 bp, Artificial Sequence
  Synthetic DNA
atataagattcactttag

SEQ ID NO: 69219 - DNA, 18 bp, Artificial Sequence
  Synthetic DNA
atataagtctcagttcag

SEQ ID NO: 69220 - DNA, 18 bp, Artificial Sequence
  Synthetic DNA
atataccattctctaatg

SEQ ID NO: 69221 - DNA, 18 bp, Artificial Sequence
  Synthetic DNA
atatacgaaactctatag

SEQ ID NO: 69222 - DNA, 18 bp, Artificial Sequence
  Synthetic DNA
atatacgacataatatag

SEQ ID NO: 69223 - DNA, 18 bp, Artificial Sequence
  Synthetic DNA
atatacgactctcattag

SEQ ID NO: 69224 - DNA, 18 bp, Artificial Sequence
  Synthetic DNA
atatacgacttaatttcg

SEQ ID NO: 69225 - DNA, 18 bp, Artificial Sequence
  Synthetic DNA
atatacgatatgctatag

SEQ ID NO: 69226 - DNA, 18 bp, Artificial Sequence
  Synthetic DNA
atatacgattcactaatg

SEQ ID NO: 69227 - DNA, 18 bp, Artificial Sequence
  Synthetic DNA
atatacgattcatattag

SEQ ID NO: 69228 - DNA, 18 bp, Artificial Sequence
  Synthetic DNA
atatacgattctcaaatg

SEQ ID NO: 69229 - DNA, 18 bp, Artificial Sequence
  Synthetic DNA
atatacgcctcacaaaag

SEQ ID NO: 69230 - DNA, 18 bp, Artificial Sequence
  Synthetic DNA
atatacgtctcattaaag

SEQ ID NO: 69231 - DNA, 18 bp, Artificial Sequence
  Synthetic DNA
atatactatccactatcg

SEQ ID NO: 69232 - DNA, 18 bp, Artificial Sequence
  Synthetic DNA
atatactattatctattg

SEQ ID NO: 69233 - DNA, 18 bp, Artificial Sequence
  Synthetic DNA
atataggatacactattg

SEQ ID NO: 69234 - DNA, 18 bp, Artificial Sequence
  Synthetic DNA
atatccgactcaattttg

SEQ ID NO: 69235 - DNA, 18 bp, Artificial Sequence
  Synthetic DNA
atatgcgaatcactaaag

SEQ ID NO: 69236 - DNA, 18 bp, Artificial Sequence
  Synthetic DNA
atatgctacacaataatg

SEQ ID NO: 69237 - DNA, 18 bp, Artificial Sequence
  Synthetic DNA
atattcgatacactatag

SEQ ID NO: 69238 - DNA, 18 bp, Artificial Sequence
  Synthetic DNA
atctacgactatctatag

SEQ ID NO: 69239 - DNA, 18 bp, Artificial Sequence
  Synthetic DNA
atgaacgacacactaaag

SEQ ID NO: 69240 - DNA, 18 bp, Artificial Sequence
  Synthetic DNA
attaacatctcactatag

SEQ ID NO: 69241 - DNA, 18 bp, Artificial Sequence
  Synthetic DNA
attaacatctcgctattg

SEQ ID NO: 69242 - DNA, 18 bp, Artificial Sequence
  Synthetic DNA
attaaccacacacaaaag

SEQ ID NO: 69243 - DNA, 18 bp, Artificial Sequence
  Synthetic DNA
attcataacccacagtag

SEQ ID NO: 69244 - DNA, 18 bp, Artificial Sequence
  Synthetic DNA
atttaccacataatattg

SEQ ID NO: 69245 - DNA, 18 bp, Artificial Sequence
  Synthetic DNA
atttacgaccaactatag

SEQ ID NO: 69246 - DNA, 18 bp, Artificial Sequence
  Synthetic DNA
atttacggctcccaaatg

SEQ ID NO: 69247 - DNA, 18 bp, Artificial Sequence
  Synthetic DNA
atttatagctcatattag

SEQ ID NO: 69248 - DNA, 18 bp, Artificial Sequence
  Synthetic DNA
attttcgattcactatag

SEQ ID NO: 69249 - DNA, 18 bp, Artificial Sequence
  Synthetic DNA
caaaacgactttctaaag

SEQ ID NO: 69250 - DNA, 18 bp, Artificial Sequence
  Synthetic DNA
caaaacggcacacaatag

SEQ ID NO: 69251 - DNA, 18 bp, Artificial Sequence
  Synthetic DNA
caaaacgtttttcaacag

SEQ ID NO: 69252 - DNA, 18 bp, Artificial Sequence
  Synthetic DNA
caaaactcctgcctattg

SEQ ID NO: 69253 - DNA, 18 bp, Artificial Sequence
  Synthetic DNA
caaaaggacacaatatgg

SEQ ID NO: 69254 - DNA, 18 bp, Artificial Sequence
  Synthetic DNA
caaaccgactcactcttg

SEQ ID NO: 69255 - DNA, 18 bp, Artificial Sequence
  Synthetic DNA
caacactacttactttag

SEQ ID NO: 69256 - DNA, 18 bp, Artificial Sequence
  Synthetic DNA
caataaatcttacaatag

SEQ ID NO: 69257 - DNA, 18 bp, Artificial Sequence
  Synthetic DNA
caataagacaccttttag

SEQ ID NO: 69258 - DNA, 18 bp, Artificial Sequence
  Synthetic DNA
caataccgctcaatttag

SEQ ID NO: 69259 - DNA, 18 bp, Artificial Sequence
  Synthetic DNA
caatacctctcgaaatag

SEQ ID NO: 69260 - DNA, 18 bp, Artificial Sequence
  Synthetic DNA
caatacgaaacacaaaag

SEQ ID NO: 69261 - DNA, 18 bp, Artificial Sequence
  Synthetic DNA
caatacgacgctcttttg

SEQ ID NO: 69262 - DNA, 18 bp, Artificial Sequence
  Synthetic DNA
caatacgactcatccagg

SEQ ID NO: 69263 - DNA, 18 bp, Artificial Sequence
  Synthetic DNA
caatacgatacactgtcg

SEQ ID NO: 69264 - DNA, 18 bp, Artificial Sequence
  Synthetic DNA
caatacgtctcacttatg

SEQ ID NO: 69265 - DNA, 18 bp, Artificial Sequence
  Synthetic DNA
caatacgtctctcaattg

SEQ ID NO: 69266 - DNA, 18 bp, Artificial Sequence
  Synthetic DNA
caatacttccttctatag

SEQ ID NO: 69267 - DNA, 18 bp, Artificial Sequence
  Synthetic DNA
caatatctcttactattg

SEQ ID NO: 69268 - DNA, 18 bp, Artificial Sequence
  Synthetic DNA
caatccgtttctcaatgg

SEQ ID NO: 69269 - DNA, 18 bp, Artificial Sequence
  Synthetic DNA
caatgcgtcccactaaag

SEQ ID NO: 69270 - DNA, 18 bp, Artificial Sequence
  Synthetic DNA
caatgcgtcctactatag

SEQ ID NO: 69271 - DNA, 18 bp, Artificial Sequence
  Synthetic DNA
caattactctcactatag

SEQ ID NO: 69272 - DNA, 18 bp, Artificial Sequence
  Synthetic DNA
caattcgatccaccatag

SEQ ID NO: 69273 - DNA, 18 bp, Artificial Sequence
  Synthetic DNA
caattcggcaaataaaag

SEQ ID NO: 69274 - DNA, 18 bp, Artificial Sequence
  Synthetic DNA
caattctagatactatag

SEQ ID NO: 69275 - DNA, 18 bp, Artificial Sequence
  Synthetic DNA
caatttaattcactatag

SEQ ID NO: 69276 - DNA, 18 bp, Artificial Sequence
  Synthetic DNA
cacaaccactcgcaattg

SEQ ID NO: 69277 - DNA, 18 bp, Artificial Sequence
  Synthetic DNA
cactaccactcgcatcag

SEQ ID NO: 69278 - DNA, 18 bp, Artificial Sequence
  Synthetic DNA
cactacgaaacactattg

SEQ ID NO: 69279 - DNA, 18 bp, Artificial Sequence
  Synthetic DNA
cactccgactccctattg

SEQ ID NO: 69280 - DNA, 18 bp, Artificial Sequence
  Synthetic DNA
caggaggaatcaccaacg

SEQ ID NO: 69281 - DNA, 18 bp, Artificial Sequence
  Synthetic DNA
catcacgaataactttag

SEQ ID NO: 69282 - DNA, 18 bp, Artificial Sequence
  Synthetic DNA
catcaggtcccactatag

SEQ ID NO: 69283 - DNA, 18 bp, Artificial Sequence
  Synthetic DNA
cattacgtcatatcatgg

SEQ ID NO: 69284 - DNA, 18 bp, Artificial Sequence
  Synthetic DNA
cattcctactcactccag

SEQ ID NO: 69285 - DNA, 18 bp, Artificial Sequence
  Synthetic DNA
catttcgaatcactaaag

SEQ ID NO: 69286 - DNA, 18 bp, Artificial Sequence
  Synthetic DNA
catttcgacacagtatag

SEQ ID NO: 69287 - DNA, 18 bp, Artificial Sequence
  Synthetic DNA
ccaaacgtcccaataaag

SEQ ID NO: 69288 - DNA, 18 bp, Artificial Sequence
  Synthetic DNA
ccatccaattctcaatag

SEQ ID NO: 69289 - DNA, 18 bp, Artificial Sequence
  Synthetic DNA
cgatacaacacacaatag

SEQ ID NO: 69290 - DNA, 18 bp, Artificial Sequence
  Synthetic DNA
cgatatggcttggtccgg

SEQ ID NO: 69291 - DNA, 18 bp, Artificial Sequence
  Synthetic DNA
cgattcgactcaatacag

SEQ ID NO: 69292 - DNA, 18 bp, Artificial Sequence
  Synthetic DNA
cgattgaaatcactatag

SEQ ID NO: 69293 - DNA, 18 bp, Artificial Sequence
  Synthetic DNA
ctaaaccacacacttcag

SEQ ID NO: 69294 - DNA, 18 bp, Artificial Sequence
  Synthetic DNA
ctaaacgtctcacaatcg

SEQ ID NO: 69295 - DNA, 18 bp, Artificial Sequence
  Synthetic DNA
ctaaactacacactatag

SEQ ID NO: 69296 - DNA, 18 bp, Artificial Sequence
  Synthetic DNA
ctagacgactttctattg

SEQ ID NO: 69297 - DNA, 18 bp, Artificial Sequence
  Synthetic DNA
ctataagacacaccatag

SEQ ID NO: 69298 - DNA, 18 bp, Artificial Sequence
  Synthetic DNA
ctatacgacacacttaag

SEQ ID NO: 69299 - DNA, 18 bp, Artificial Sequence
  Synthetic DNA
ctatacgactcaatcttg

SEQ ID NO: 69300 - DNA, 18 bp, Artificial Sequence
  Synthetic DNA
ctatacgactcgctaatg

SEQ ID NO: 69301 - DNA, 18 bp, Artificial Sequence
  Synthetic DNA
ctatacgattctataatg

SEQ ID NO: 69302 - DNA, 18 bp, Artificial Sequence
  Synthetic DNA
ctatacgtctgacttaag

SEQ ID NO: 69303 - DNA, 18 bp, Artificial Sequence
  Synthetic DNA
ctatagcattatctatag

SEQ ID NO: 69304 - DNA, 18 bp, Artificial Sequence
  Synthetic DNA
ctatttaacacactatag

SEQ ID NO: 69305 - DNA, 18 bp, Artificial Sequence
  Synthetic DNA
ctgtgcgattcaataaag

SEQ ID NO: 69306 - DNA, 18 bp, Artificial Sequence
  Synthetic DNA
ctgtgggactcactatag

SEQ ID NO: 69307 - DNA, 18 bp, Artificial Sequence
  Synthetic DNA
cttaacgtttcacttttg

SEQ ID NO: 69308 - DNA, 18 bp, Artificial Sequence
  Synthetic DNA
ctttccgactctataacg

SEQ ID NO: 69309 - DNA, 18 bp, Artificial Sequence
  Synthetic DNA
gaaatcatctcactatag

SEQ ID NO: 69310 - DNA, 18 bp, Artificial Sequence
  Synthetic DNA
gaacacgacctgctatag

SEQ ID NO: 69311 - DNA, 18 bp, Artificial Sequence
  Synthetic DNA
gaacgtgactcacattag

SEQ ID NO: 69312 - DNA, 18 bp, Artificial Sequence
  Synthetic DNA
gaactcgtcactcaattg

SEQ ID NO: 69313 - DNA, 18 bp, Artificial Sequence
  Synthetic DNA
gaataaaatacactattg

SEQ ID NO: 69314 - DNA, 18 bp, Artificial Sequence
  Synthetic DNA
gaatacctctccttacag

SEQ ID NO: 69315 - DNA, 18 bp, Artificial Sequence
  Synthetic DNA
gaatgctactcatttttg

SEQ ID NO: 69316 - DNA, 18 bp, Artificial Sequence
  Synthetic DNA
gatttcgactcacttgag

SEQ ID NO: 69317 - DNA, 18 bp, Artificial Sequence
  Synthetic DNA
gcaaacgactgactattg

SEQ ID NO: 69318 - DNA, 18 bp, Artificial Sequence
  Synthetic DNA
gcttgcgactcattaaag

SEQ ID NO: 69319 - DNA, 18 bp, Artificial Sequence
  Synthetic DNA
gtacacgactcaatcatg

SEQ ID NO: 69320 - DNA, 18 bp, Artificial Sequence
  Synthetic DNA
gtatacgaatctttatag

SEQ ID NO: 69321 - DNA, 18 bp, Artificial Sequence
  Synthetic DNA
gtatacgactatcaatag

SEQ ID NO: 69322 - DNA, 18 bp, Artificial Sequence
  Synthetic DNA
taaaaacacttagtaatg

SEQ ID NO: 69323 - DNA, 18 bp, Artificial Sequence
  Synthetic DNA
taaaaagaatcactaatg

SEQ ID NO: 69324 - DNA, 18 bp, Artificial Sequence
  Synthetic DNA
taaaaagactgacctaag

SEQ ID NO: 69325 - DNA, 18 bp, Artificial Sequence
  Synthetic DNA
taaaaagactttcaaaag

SEQ ID NO: 69326 - DNA, 18 bp, Artificial Sequence
  Synthetic DNA
taaaaagatacaccatag

SEQ ID NO: 69327 - DNA, 18 bp, Artificial Sequence
  Synthetic DNA
taaaacaaccctcaatag

SEQ ID NO: 69328 - DNA, 18 bp, Artificial Sequence
  Synthetic DNA
taaaacaactaaccattg

SEQ ID NO: 69329 - DNA, 18 bp, Artificial Sequence
  Synthetic DNA
taaaacaactcgattaag

SEQ ID NO: 69330 - DNA, 18 bp, Artificial Sequence
  Synthetic DNA
taaaacaattcactgtcg

SEQ ID NO: 69331 - DNA, 18 bp, Artificial Sequence
  Synthetic DNA
taaaacccatcaataaag

SEQ ID NO: 69332 - DNA, 18 bp, Artificial Sequence
  Synthetic DNA
taaaacgaaccaccattg

SEQ ID NO: 69333 - DNA, 18 bp, Artificial Sequence
  Synthetic DNA
taaaacgacatacttttg

SEQ ID NO: 69334 - DNA, 18 bp, Artificial Sequence
  Synthetic DNA
taaaacgacgctcaatcg

SEQ ID NO: 69335 - DNA, 18 bp, Artificial Sequence
  Synthetic DNA
taaaacgactcgccaatg

SEQ ID NO: 69336 - DNA, 18 bp, Artificial Sequence
  Synthetic DNA
taaaacgattcaacattg

SEQ ID NO: 69337 - DNA, 18 bp, Artificial Sequence
  Synthetic DNA
taaaacgatttaccaatg

SEQ ID NO: 69338 - DNA, 18 bp, Artificial Sequence
  Synthetic DNA
taaaacgcccctttatag

SEQ ID NO: 69339 - DNA, 18 bp, Artificial Sequence
  Synthetic DNA
taaaacggatcacttaag

SEQ ID NO: 69340 - DNA, 18 bp, Artificial Sequence
  Synthetic DNA
taaaacggatcgctattg

SEQ ID NO: 69341 - DNA, 18 bp, Artificial Sequence
  Synthetic DNA
taaaacgtcagtcactag

SEQ ID NO: 69342 - DNA, 18 bp, Artificial Sequence
  Synthetic DNA
taaaacgtccaactagag

SEQ ID NO: 69343 - DNA, 18 bp, Artificial Sequence
  Synthetic DNA
taaaacgtcgctccatag

SEQ ID NO: 69344 - DNA, 18 bp, Artificial Sequence
  Synthetic DNA
taaaacgtctaacaagag

SEQ ID NO: 69345 - DNA, 18 bp, Artificial Sequence
  Synthetic DNA
taaaactacacacttcag

SEQ ID NO: 69346 - DNA, 18 bp, Artificial Sequence
  Synthetic DNA
taaaactactcacaaacg

SEQ ID NO: 69347 - DNA, 18 bp, Artificial Sequence
  Synthetic DNA
taaaactcctcgccatag

SEQ ID NO: 69348 - DNA, 18 bp, Artificial Sequence
  Synthetic DNA
taaaacttcccaatatag

SEQ ID NO: 69349 - DNA, 18 bp, Artificial Sequence
  Synthetic DNA
taaaacttttcactaaag

SEQ ID NO: 69350 - DNA, 18 bp, Artificial Sequence
  Synthetic DNA
taaaatgatttactgtag

SEQ ID NO: 69351 - DNA, 18 bp, Artificial Sequence
  Synthetic DNA
taaaccaactcactcaag

SEQ ID NO: 69352 - DNA, 18 bp, Artificial Sequence
  Synthetic DNA
taaaccgaaaaactagag

SEQ ID NO: 69353 - DNA, 18 bp, Artificial Sequence
  Synthetic DNA
taaaccgacacacttaag

SEQ ID NO: 69354 - DNA, 18 bp, Artificial Sequence
  Synthetic DNA
taaacctacacactattg

SEQ ID NO: 69355 - DNA, 18 bp, Artificial Sequence
  Synthetic DNA
taaacggactgattatag

SEQ ID NO: 69356 - DNA, 18 bp, Artificial Sequence
  Synthetic DNA
taaacggacttcctgtag

SEQ ID NO: 69357 - DNA, 18 bp, Artificial Sequence
  Synthetic DNA
taaagcgtctctcaacag

SEQ ID NO: 69358 - DNA, 18 bp, Artificial Sequence
  Synthetic DNA
taaagcgttttactatag

SEQ ID NO: 69359 - DNA, 18 bp, Artificial Sequence
  Synthetic DNA
taaagtgactcgctacag

SEQ ID NO: 69360 - DNA, 18 bp, Artificial Sequence
  Synthetic DNA
taaatcaactaactaatg

SEQ ID NO: 69361 - DNA, 18 bp, Artificial Sequence
  Synthetic DNA
taaatcatctcactaaag

SEQ ID NO: 69362 - DNA, 18 bp, Artificial Sequence
  Synthetic DNA
taaatcgactcacaaatg

SEQ ID NO: 69363 - DNA, 18 bp, Artificial Sequence
  Synthetic DNA
taaatcgactctttattg

SEQ ID NO: 69364 - DNA, 18 bp, Artificial Sequence
  Synthetic DNA
taaatcgatccaatatag

SEQ ID NO: 69365 - DNA, 18 bp, Artificial Sequence
  Synthetic DNA
taaatcgtcacacaatag

SEQ ID NO: 69366 - DNA, 18 bp, Artificial Sequence
  Synthetic DNA
taaatcgtctcactaagg

SEQ ID NO: 69367 - DNA, 18 bp, Artificial Sequence
  Synthetic DNA
taaatcgtctctctattg

SEQ ID NO: 69368 - DNA, 18 bp, Artificial Sequence
  Synthetic DNA
taaatcttctctctttag

SEQ ID NO: 69369 - DNA, 18 bp, Artificial Sequence
  Synthetic DNA
taaatggactaactattg

SEQ ID NO: 69370 - DNA, 18 bp, Artificial Sequence
  Synthetic DNA
taaattgactcataatag

SEQ ID NO: 69371 - DNA, 18 bp, Artificial Sequence
  Synthetic DNA
taacaagaatcactggag

SEQ ID NO: 69372 - DNA, 18 bp, Artificial Sequence
  Synthetic DNA
taacaagactctgtttag

SEQ ID NO: 69373 - DNA, 18 bp, Artificial Sequence
  Synthetic DNA
taacaatcctcactcaag

SEQ ID NO: 69374 - DNA, 18 bp, Artificial Sequence
  Synthetic DNA
taacacatcacacgatcg

SEQ ID NO: 69375 - DNA, 18 bp, Artificial Sequence
  Synthetic DNA
taacacgacacaatgttg

SEQ ID NO: 69376 - DNA, 18 bp, Artificial Sequence
  Synthetic DNA
taacacgagaatataatg

SEQ ID NO: 69377 - DNA, 18 bp, Artificial Sequence
  Synthetic DNA
taacacgatacctaatgg

SEQ ID NO: 69378 - DNA, 18 bp, Artificial Sequence
  Synthetic DNA
taacacgtctttctttag

SEQ ID NO: 69379 - DNA, 18 bp, Artificial Sequence
  Synthetic DNA
taacactactcaatacgg

SEQ ID NO: 69380 - DNA, 18 bp, Artificial Sequence
  Synthetic DNA
taacagtcctctcaatag

SEQ ID NO: 69381 - DNA, 18 bp, Artificial Sequence
  Synthetic DNA
taacatacatgattacag

SEQ ID NO: 69382 - DNA, 18 bp, Artificial Sequence
  Synthetic DNA
taacatgattctctattg

SEQ ID NO: 69383 - DNA, 18 bp, Artificial Sequence
  Synthetic DNA
taaccggattccgcatag

SEQ ID NO: 69384 - DNA, 18 bp, Artificial Sequence
  Synthetic DNA
taacgcgactctgtaatg

SEQ ID NO: 69385 - DNA, 18 bp, Artificial Sequence
  Synthetic DNA
taactccactaactgaag

SEQ ID NO: 69386 - DNA, 18 bp, Artificial Sequence
  Synthetic DNA
taactcgactctcactag

SEQ ID NO: 69387 - DNA, 18 bp, Artificial Sequence
  Synthetic DNA
taactcgatttactaaag

SEQ ID NO: 69388 - DNA, 18 bp, Artificial Sequence
  Synthetic DNA
taactcgcccctccatgg

SEQ ID NO: 69389 - DNA, 18 bp, Artificial Sequence
  Synthetic DNA
taactcgcctgaattatg

SEQ ID NO: 69390 - DNA, 18 bp, Artificial Sequence
  Synthetic DNA
taactctaaacactatag

SEQ ID NO: 69391 - DNA, 18 bp, Artificial Sequence
  Synthetic DNA
taactctacgcacaattg

SEQ ID NO: 69392 - DNA, 18 bp, Artificial Sequence
  Synthetic DNA
taactctacgcactattg

SEQ ID NO: 69393 - DNA, 18 bp, Artificial Sequence
  Synthetic DNA
taactggactttcattag

SEQ ID NO: 69394 - DNA, 18 bp, Artificial Sequence
  Synthetic DNA
taacttgactgtctagag

SEQ ID NO: 69395 - DNA, 18 bp, Artificial Sequence
  Synthetic DNA
taacttgtcacacatgcg

SEQ ID NO: 69396 - DNA, 18 bp, Artificial Sequence
  Synthetic DNA
taagaagtcacaattttg

SEQ ID NO: 69397 - DNA, 18 bp, Artificial Sequence
  Synthetic DNA
taagacgacgatctacag

SEQ ID NO: 69398 - DNA, 18 bp, Artificial Sequence
  Synthetic DNA
taagacgtttctcgaaag

SEQ ID NO: 69399 - DNA, 18 bp, Artificial Sequence
  Synthetic DNA
taagactactctcttaag

SEQ ID NO: 69400 - DNA, 18 bp, Artificial Sequence
  Synthetic DNA
taagatgcctccaaatag

SEQ ID NO: 69401 - DNA, 18 bp, Artificial Sequence
  Synthetic DNA
taagccaaatcacaaaag

SEQ ID NO: 69402 - DNA, 18 bp, Artificial Sequence
  Synthetic DNA
taataaaatccacgatag

SEQ ID NO: 69403 - DNA, 18 bp, Artificial Sequence
  Synthetic DNA
taataaaattcacttttg

SEQ ID NO: 69404 - DNA, 18 bp, Artificial Sequence
  Synthetic DNA
taataagaataactagtg

SEQ ID NO: 69405 - DNA, 18 bp, Artificial Sequence
  Synthetic DNA
taataagcctaacttttg

SEQ ID NO: 69406 - DNA, 18 bp, Artificial Sequence
  Synthetic DNA
taataaggctcctcatag

SEQ ID NO: 69407 - DNA, 18 bp, Artificial Sequence
  Synthetic DNA
taataagtcactctacag

SEQ ID NO: 69408 - DNA, 18 bp, Artificial Sequence
  Synthetic DNA
taataatacattctatcg

SEQ ID NO: 69409 - DNA, 18 bp, Artificial Sequence
  Synthetic DNA
taatacaaatcacaaatg

SEQ ID NO: 69410 - DNA, 18 bp, Artificial Sequence
  Synthetic DNA
taatacaacaatttatag

SEQ ID NO: 69411 - DNA, 18 bp, Artificial Sequence
  Synthetic DNA
taatacaacatcttttag

SEQ ID NO: 69412 - DNA, 18 bp, Artificial Sequence
  Synthetic DNA
taatacaactcttttaag

SEQ ID NO: 69413 - DNA, 18 bp, Artificial Sequence
  Synthetic DNA
taatacaactttctatca

SEQ ID NO: 69414 - DNA, 18 bp, Artificial Sequence
  Synthetic DNA
taatacaattcatattag

SEQ ID NO: 69415 - DNA, 18 bp, Artificial Sequence
  Synthetic DNA
taatacacgtccttatag

SEQ ID NO: 69416 - DNA, 18 bp, Artificial Sequence
  Synthetic DNA
taatacatcactcaattg

SEQ ID NO: 69417 - DNA, 18 bp, Artificial Sequence
  Synthetic DNA
taatacatttctctgtag

SEQ ID NO: 69418 - DNA, 18 bp, Artificial Sequence
  Synthetic DNA
taataccaaacacattag

SEQ ID NO: 69419 - DNA, 18 bp, Artificial Sequence
  Synthetic DNA
taataccacactcattag

SEQ ID NO: 69420 - DNA, 18 bp, Artificial Sequence
  Synthetic DNA
taataccactctcataag

SEQ ID NO: 69421 - DNA, 18 bp, Artificial Sequence
  Synthetic DNA
taataccactctcttatg

SEQ ID NO: 69422 - DNA, 18 bp, Artificial Sequence
  Synthetic DNA
taataccgctcgcaattg

SEQ ID NO: 69423 - DNA, 18 bp, Artificial Sequence
  Synthetic DNA
taatacctctcaaatcag

SEQ ID NO: 69424 - DNA, 18 bp, Artificial Sequence
  Synthetic DNA
taatacctttcaccattg

SEQ ID NO: 69425 - DNA, 18 bp, Artificial Sequence
  Synthetic DNA
taatacgaacatcttcag

SEQ ID NO: 69426 - DNA, 18 bp, Artificial Sequence
  Synthetic DNA
taatacgaagctcctaag

SEQ ID NO: 69427 - DNA, 18 bp, Artificial Sequence
  Synthetic DNA
taatacgaatcttcaatg

SEQ ID NO: 69428 - DNA, 18 bp, Artificial Sequence
  Synthetic DNA
taatacgaattatttcag

SEQ ID NO: 69429 - DNA, 18 bp, Artificial Sequence
  Synthetic DNA
taatacgacactaaatgg

SEQ ID NO: 69430 - DNA, 18 bp, Artificial Sequence
  Synthetic DNA
taatacgacactccaatg

SEQ ID NO: 69431 - DNA, 18 bp, Artificial Sequence
  Synthetic DNA
taatacgacatatttttg

SEQ ID NO: 69432 - DNA, 18 bp, Artificial Sequence
  Synthetic DNA
taatacgacctacatacg

SEQ ID NO: 69433 - DNA, 18 bp, Artificial Sequence
  Synthetic DNA
taatacgactagcatcaa

SEQ ID NO: 69434 - DNA, 18 bp, Artificial Sequence
  Synthetic DNA
taatacgatccgcaatgg

SEQ ID NO: 69435 - DNA, 18 bp, Artificial Sequence
  Synthetic DNA
taatacgccccagtgttg

SEQ ID NO: 69436 - DNA, 18 bp, Artificial Sequence
  Synthetic DNA
taatacgccttagcattg

SEQ ID NO: 69437 - DNA, 18 bp, Artificial Sequence
  Synthetic DNA
taatacggctgaaagtgg

SEQ ID NO: 69438 - DNA, 18 bp, Artificial Sequence
  Synthetic DNA
taatacgtaacacactag

SEQ ID NO: 69439 - DNA, 18 bp, Artificial Sequence
  Synthetic DNA
taatacgtacatctatag

SEQ ID NO: 69440 - DNA, 18 bp, Artificial Sequence
  Synthetic DNA
taatacgtatggcaaaag

SEQ ID NO: 69441 - DNA, 18 bp, Artificial Sequence
  Synthetic DNA
taatacgtcagtttatag

SEQ ID NO: 69442 - DNA, 18 bp, Artificial Sequence
  Synthetic DNA
taatacgtctcataactg

SEQ ID NO: 69443 - DNA, 18 bp, Artificial Sequence
  Synthetic DNA
taatacgtttctctgcag

SEQ ID NO: 69444 - DNA, 18 bp, Artificial Sequence
  Synthetic DNA
taatacgtttttctgttg

SEQ ID NO: 69445 - DNA, 18 bp, Artificial Sequence
  Synthetic DNA
taatactaatgactaacg

SEQ ID NO: 69446 - DNA, 18 bp, Artificial Sequence
  Synthetic DNA
taatactacgcagtgatg

SEQ ID NO: 69447 - DNA, 18 bp, Artificial Sequence
  Synthetic DNA
taatactactcaaagaag

SEQ ID NO: 69448 - DNA, 18 bp, Artificial Sequence
  Synthetic DNA
taatactataggctatag

SEQ ID NO: 69449 - DNA, 18 bp, Artificial Sequence
  Synthetic DNA
taatactctccttaatag

SEQ ID NO: 69450 - DNA, 18 bp, Artificial Sequence
  Synthetic DNA
taatacttatcacaattg

SEQ ID NO: 69451 - DNA, 18 bp, Artificial Sequence
  Synthetic DNA
taatacttcatactaaag

SEQ ID NO: 69452 - DNA, 18 bp, Artificial Sequence
  Synthetic DNA
taatacttctccctcaag

SEQ ID NO: 69453 - DNA, 18 bp, Artificial Sequence
  Synthetic DNA
taatacttctctttaaag

SEQ ID NO: 69454 - DNA, 18 bp, Artificial Sequence
  Synthetic DNA
taatacttctgacctgag

SEQ ID NO: 69455 - DNA, 18 bp, Artificial Sequence
  Synthetic DNA
taatacttcttcctttag

SEQ ID NO: 69456 - DNA, 18 bp, Artificial Sequence
  Synthetic DNA
taatacttctttgtatag

SEQ ID NO: 69457 - DNA, 18 bp, Artificial Sequence
  Synthetic DNA
taatagcactaacgaaag

SEQ ID NO: 69458 - DNA, 18 bp, Artificial Sequence
  Synthetic DNA
taataggaaactctattg

SEQ ID NO: 69459 - DNA, 18 bp, Artificial Sequence
  Synthetic DNA
taataggacactcgatgg

SEQ ID NO: 69460 - DNA, 18 bp, Artificial Sequence
  Synthetic DNA
taataggactcaattctg

SEQ ID NO: 69461 - DNA, 18 bp, Artificial Sequence
  Synthetic DNA
taataggtctgtctataa

SEQ ID NO: 69462 - DNA, 18 bp, Artificial Sequence
  Synthetic DNA
taataggtcttactcccg

SEQ ID NO: 69463 - DNA, 18 bp, Artificial Sequence
  Synthetic DNA
taatagtgctcgctgtag

SEQ ID NO: 69464 - DNA, 18 bp, Artificial Sequence
  Synthetic DNA
taatatctctcacattag

SEQ ID NO: 69465 - DNA, 18 bp, Artificial Sequence
  Synthetic DNA
taatatgacgctcagttg

SEQ ID NO: 69466 - DNA, 18 bp, Artificial Sequence
  Synthetic DNA
taatatgattagctttag

SEQ ID NO: 69467 - DNA, 18 bp, Artificial Sequence
  Synthetic DNA
taatatgatttactttcg

SEQ ID NO: 69468 - DNA, 18 bp, Artificial Sequence
  Synthetic DNA
taatatgccatgcaatag

SEQ ID NO: 69469 - DNA, 18 bp, Artificial Sequence
  Synthetic DNA
taatatgtcaaacattag

SEQ ID NO: 69470 - DNA, 18 bp, Artificial Sequence
  Synthetic DNA
taatatgtctccatttag

SEQ ID NO: 69471 - DNA, 18 bp, Artificial Sequence
  Synthetic DNA
taatatgtctctctcttg

SEQ ID NO: 69472 - DNA, 18 bp, Artificial Sequence
  Synthetic DNA
taatattactcaaaatgg

SEQ ID NO: 69473 - DNA, 18 bp, Artificial Sequence
  Synthetic DNA
taatattccttgctttag

SEQ ID NO: 69474 - DNA, 18 bp, Artificial Sequence
  Synthetic DNA
taatcagactcccattag

SEQ ID NO: 69475 - DNA, 18 bp, Artificial Sequence
  Synthetic DNA
taatcagtcacactttag

SEQ ID NO: 69476 - DNA, 18 bp, Artificial Sequence
  Synthetic DNA
taatcataatcgctatag

SEQ ID NO: 69477 - DNA, 18 bp, Artificial Sequence
  Synthetic DNA
taatccgaacgacgatag

SEQ ID NO: 69478 - DNA, 18 bp, Artificial Sequence
  Synthetic DNA
taatccgactcagattcg

SEQ ID NO: 69479 - DNA, 18 bp, Artificial Sequence
  Synthetic DNA
taatccgagatacgaaag

SEQ ID NO: 69480 - DNA, 18 bp, Artificial Sequence
  Synthetic DNA
taatccgtctcaataacg

SEQ ID NO: 69481 - DNA, 18 bp, Artificial Sequence
  Synthetic DNA
taatctcaatcccaatag

SEQ ID NO: 69482 - DNA, 18 bp, Artificial Sequence
  Synthetic DNA
taatcttactcgccatag

SEQ ID NO: 69483 - DNA, 18 bp, Artificial Sequence
  Synthetic DNA
taatgagactcttttaag

SEQ ID NO: 69484 - DNA, 18 bp, Artificial Sequence
  Synthetic DNA
taatgcaaccaactattg

SEQ ID NO: 69485 - DNA, 18 bp, Artificial Sequence
  Synthetic DNA
taatgcagctctctattg

SEQ ID NO: 69486 - DNA, 18 bp, Artificial Sequence
  Synthetic DNA
taatgccttccattatag

SEQ ID NO: 69487 - DNA, 18 bp, Artificial Sequence
  Synthetic DNA
taatgcgactaattactg

SEQ ID NO: 69488 - DNA, 18 bp, Artificial Sequence
  Synthetic DNA
taatgcgagacacttttg

SEQ ID NO: 69489 - DNA, 18 bp, Artificial Sequence
  Synthetic DNA
taatgcgattctttaaag

SEQ ID NO: 69490 - DNA, 18 bp, Artificial Sequence
  Synthetic DNA
taatggaatttactatag

SEQ ID NO: 69491 - DNA, 18 bp, Artificial Sequence
  Synthetic DNA
taattaaactcgatatag

SEQ ID NO: 69492 - DNA, 18 bp, Artificial Sequence
  Synthetic DNA
taattcaaatctatattg

SEQ ID NO: 69493 - DNA, 18 bp, Artificial Sequence
  Synthetic DNA
taattcaacagacgatag

SEQ ID NO: 69494 - DNA, 18 bp, Artificial Sequence
  Synthetic DNA
taattcaacttgctagag

SEQ ID NO: 69495 - DNA, 18 bp, Artificial Sequence
  Synthetic DNA
taattcaatttaatattg

SEQ ID NO: 69496 - DNA, 18 bp, Artificial Sequence
  Synthetic DNA
taattcatctctctctag

SEQ ID NO: 69497 - DNA, 18 bp, Artificial Sequence
  Synthetic DNA
taattccaaccagtatag

SEQ ID NO: 69498 - DNA, 18 bp, Artificial Sequence
  Synthetic DNA
taattcgaactttattag

SEQ ID NO: 69499 - DNA, 18 bp, Artificial Sequence
  Synthetic DNA
taattcgaatctcaattg

SEQ ID NO: 69500 - DNA, 18 bp, Artificial Sequence
  Synthetic DNA
taattcgaattacaacag

SEQ ID NO: 69501 - DNA, 18 bp, Artificial Sequence
  Synthetic DNA
taattcgacactttattg

SEQ ID NO: 69502 - DNA, 18 bp, Artificial Sequence
  Synthetic DNA
taattcgactaagaaaag

SEQ ID NO: 69503 - DNA, 18 bp, Artificial Sequence
  Synthetic DNA
taattcgagatactgtag

SEQ ID NO: 69504 - DNA, 18 bp, Artificial Sequence
  Synthetic DNA
taattcgtttcaatttag

SEQ ID NO: 69505 - DNA, 18 bp, Artificial Sequence
  Synthetic DNA
taattctcttcttcgtag

SEQ ID NO: 69506 - DNA, 18 bp, Artificial Sequence
  Synthetic DNA
taattctgcttacaatag

SEQ ID NO: 69507 - DNA, 18 bp, Artificial Sequence
  Synthetic DNA
taattcttctcacaattg

SEQ ID NO: 69508 - DNA, 18 bp, Artificial Sequence
  Synthetic DNA
taattcttctctctttag

SEQ ID NO: 69509 - DNA, 18 bp, Artificial Sequence
  Synthetic DNA
taattggtcacacgatag

SEQ ID NO: 69510 - DNA, 18 bp, Artificial Sequence
  Synthetic DNA
taatttgacattctctag

SEQ ID NO: 69511 - DNA, 18 bp, Artificial Sequence
  Synthetic DNA
taatttgcctcacttcag

SEQ ID NO: 69512 - DNA, 18 bp, Artificial Sequence
  Synthetic DNA
taatttggctcacttgag

SEQ ID NO: 69513 - DNA, 18 bp, Artificial Sequence
  Synthetic DNA
taatttgtatcaccatag

SEQ ID NO: 69514 - DNA, 18 bp, Artificial Sequence
  Synthetic DNA
taatttttttcactaaag

SEQ ID NO: 69515 - DNA, 18 bp, Artificial Sequence
  Synthetic DNA
tacaaagactccctattg

SEQ ID NO: 69516 - DNA, 18 bp, Artificial Sequence
  Synthetic DNA
tacaaagacttagtatag

SEQ ID NO: 69517 - DNA, 18 bp, Artificial Sequence
  Synthetic DNA
tacaacgacacacttttg

SEQ ID NO: 69518 - DNA, 18 bp, Artificial Sequence
  Synthetic DNA
tacaacgtctatctatag

SEQ ID NO: 69519 - DNA, 18 bp, Artificial Sequence
  Synthetic DNA
tacaaggactctctttag

SEQ ID NO: 69520 - DNA, 18 bp, Artificial Sequence
  Synthetic DNA
tacaccgacagtctagag

SEQ ID NO: 69521 - DNA, 18 bp, Artificial Sequence
  Synthetic DNA
taccacgagttactctcg

SEQ ID NO: 69522 - DNA, 18 bp, Artificial Sequence
  Synthetic DNA
tacctcaactcactttag

SEQ ID NO: 69523 - DNA, 18 bp, Artificial Sequence
  Synthetic DNA
tacgacgactaaacatag

SEQ ID NO: 69524 - DNA, 18 bp, Artificial Sequence
  Synthetic DNA
tacgatgacaaagtgtag

SEQ ID NO: 69525 - DNA, 18 bp, Artificial Sequence
  Synthetic DNA
tactaagaataacattag

SEQ ID NO: 69526 - DNA, 18 bp, Artificial Sequence
  Synthetic DNA
tactaagactcagtaatg

SEQ ID NO: 69527 - DNA, 18 bp, Artificial Sequence
  Synthetic DNA
tactacgagtcatttcag

SEQ ID NO: 69528 - DNA, 18 bp, Artificial Sequence
  Synthetic DNA
tactacgcatacctgtag

SEQ ID NO: 69529 - DNA, 18 bp, Artificial Sequence
  Synthetic DNA
tactatgactttttaaag

SEQ ID NO: 69530 - DNA, 18 bp, Artificial Sequence
  Synthetic DNA
tactcagacttactattg

SEQ ID NO: 69531 - DNA, 18 bp, Artificial Sequence
  Synthetic DNA
tactcccactcattttag

SEQ ID NO: 69532 - DNA, 18 bp, Artificial Sequence
  Synthetic DNA
tactccgcctcacttttg

SEQ ID NO: 69533 - DNA, 18 bp, Artificial Sequence
  Synthetic DNA
tactcctactgattattg

SEQ ID NO: 69534 - DNA, 18 bp, Artificial Sequence
  Synthetic DNA
tactgcgacacattattg

SEQ ID NO: 69535 - DNA, 18 bp, Artificial Sequence
  Synthetic DNA
tacttagactcaataatg

SEQ ID NO: 69536 - DNA, 18 bp, Artificial Sequence
  Synthetic DNA
tacttagactctcaattg

SEQ ID NO: 69537 - DNA, 18 bp, Artificial Sequence
  Synthetic DNA
tacttcaactgaccatag

SEQ ID NO: 69538 - DNA, 18 bp, Artificial Sequence
  Synthetic DNA
tactttgacgctgcttag

SEQ ID NO: 69539 - DNA, 18 bp, Artificial Sequence
  Synthetic DNA
tagaacaattcaatatcg

SEQ ID NO: 69540 - DNA, 18 bp, Artificial Sequence
  Synthetic DNA
tagaacatctctctatag

SEQ ID NO: 69541 - DNA, 18 bp, Artificial Sequence
  Synthetic DNA
tagaacgacacagtattg

SEQ ID NO: 69542 - DNA, 18 bp, Artificial Sequence
  Synthetic DNA
tagaacgagccattatgg

SEQ ID NO: 69543 - DNA, 18 bp, Artificial Sequence
  Synthetic DNA
tagaacgatccactaaag

SEQ ID NO: 69544 - DNA, 18 bp, Artificial Sequence
  Synthetic DNA
tagaacgcctaactaaag

SEQ ID NO: 69545 - DNA, 18 bp, Artificial Sequence
  Synthetic DNA
tagcaagactcattattg

SEQ ID NO: 69546 - DNA, 18 bp, Artificial Sequence
  Synthetic DNA
tagcaggtatcttgttgg

SEQ ID NO: 69547 - DNA, 18 bp, Artificial Sequence
  Synthetic DNA
tagcatgactcataaaag

SEQ ID NO: 69548 - DNA, 18 bp, Artificial Sequence
  Synthetic DNA
tagcgcgtctcacaattg

SEQ ID NO: 69549 - DNA, 18 bp, Artificial Sequence
  Synthetic DNA
tagctcagctcacttttg

SEQ ID NO: 69550 - DNA, 18 bp, Artificial Sequence
  Synthetic DNA
taggatgtctgactatag

SEQ ID NO: 69551 - DNA, 18 bp, Artificial Sequence
  Synthetic DNA
tagtaagaatacctatag

SEQ ID NO: 69552 - DNA, 18 bp, Artificial Sequence
  Synthetic DNA
tagtacaacttccaatag

SEQ ID NO: 69553 - DNA, 18 bp, Artificial Sequence
  Synthetic DNA
tagtacatatctctatag

SEQ ID NO: 69554 - DNA, 18 bp, Artificial Sequence
  Synthetic DNA
tagtacgattctcattag

SEQ ID NO: 69555 - DNA, 18 bp, Artificial Sequence
  Synthetic DNA
tagtactacgctcaatcg

SEQ ID NO: 69556 - DNA, 18 bp, Artificial Sequence
  Synthetic DNA
tagtataacacaatgtag

SEQ ID NO: 69557 - DNA, 18 bp, Artificial Sequence
  Synthetic DNA
tagtataagccactatag

SEQ ID NO: 69558 - DNA, 18 bp, Artificial Sequence
  Synthetic DNA
tagtatctttgattatag

SEQ ID NO: 69559 - DNA, 18 bp, Artificial Sequence
  Synthetic DNA
tagtatgacacactaagg

SEQ ID NO: 69560 - DNA, 18 bp, Artificial Sequence
  Synthetic DNA
tagtatgacgcagtactg

SEQ ID NO: 69561 - DNA, 18 bp, Artificial Sequence
  Synthetic DNA
tagttaaacactctatag

SEQ ID NO: 69562 - DNA, 18 bp, Artificial Sequence
  Synthetic DNA
tagttcaccccacattag

SEQ ID NO: 69563 - DNA, 18 bp, Artificial Sequence
  Synthetic DNA
tagttccgctcactacag

SEQ ID NO: 69564 - DNA, 18 bp, Artificial Sequence
  Synthetic DNA
tagttcgactcaaaaaag

SEQ ID NO: 69565 - DNA, 18 bp, Artificial Sequence
  Synthetic DNA
tataaagattcaatattg

SEQ ID NO: 69566 - DNA, 18 bp, Artificial Sequence
  Synthetic DNA
tataacaaatcactattg

SEQ ID NO: 69567 - DNA, 18 bp, Artificial Sequence
  Synthetic DNA
tataacaacacactaaag

SEQ ID NO: 69568 - DNA, 18 bp, Artificial Sequence
  Synthetic DNA
tataacctatcgctaaag

SEQ ID NO: 69569 - DNA, 18 bp, Artificial Sequence
  Synthetic DNA
tataacgactaaattcag

SEQ ID NO: 69570 - DNA, 18 bp, Artificial Sequence
  Synthetic DNA
tataacgacttactcttg

SEQ ID NO: 69571 - DNA, 18 bp, Artificial Sequence
  Synthetic DNA
tataacgccccacaatag

SEQ ID NO: 69572 - DNA, 18 bp, Artificial Sequence
  Synthetic DNA
tataacgcctcactttcg

SEQ ID NO: 69573 - DNA, 18 bp, Artificial Sequence
  Synthetic DNA
tataacggctctctattg

SEQ ID NO: 69574 - DNA, 18 bp, Artificial Sequence
  Synthetic DNA
tataacggctctcttttg

SEQ ID NO: 69575 - DNA, 18 bp, Artificial Sequence
  Synthetic DNA
tataacgtctcataatag

SEQ ID NO: 69576 - DNA, 18 bp, Artificial Sequence
  Synthetic DNA
tataacgtcttgctctag

SEQ ID NO: 69577 - DNA, 18 bp, Artificial Sequence
  Synthetic DNA
tataacgttttactatag

SEQ ID NO: 69578 - DNA, 18 bp, Artificial Sequence
  Synthetic DNA
tataactagtcactatcg

SEQ ID NO: 69579 - DNA, 18 bp, Artificial Sequence
  Synthetic DNA
tataagctctcacagtag

SEQ ID NO: 69580 - DNA, 18 bp, Artificial Sequence
  Synthetic DNA
tataataactcacaggtg

SEQ ID NO: 69581 - DNA, 18 bp, Artificial Sequence
  Synthetic DNA
tataatgagtctctatag

SEQ ID NO: 69582 - DNA, 18 bp, Artificial Sequence
  Synthetic DNA
tataatgtcacacaatag

SEQ ID NO: 69583 - DNA, 18 bp, Artificial Sequence
  Synthetic DNA
tataattactcactaaag

SEQ ID NO: 69584 - DNA, 18 bp, Artificial Sequence
  Synthetic DNA
tatagcaactctctaaag

SEQ ID NO: 69585 - DNA, 18 bp, Artificial Sequence
  Synthetic DNA
tatatcgactctcgatag

SEQ ID NO: 69586 - DNA, 18 bp, Artificial Sequence
  Synthetic DNA
tatcaagagtttctgtag

SEQ ID NO: 69587 - DNA, 18 bp, Artificial Sequence
  Synthetic DNA
tatcacgacagtctatag

SEQ ID NO: 69588 - DNA, 18 bp, Artificial Sequence
  Synthetic DNA
tatcacgacttactttcg

SEQ ID NO: 69589 - DNA, 18 bp, Artificial Sequence
  Synthetic DNA
tatcacgctttactattg

SEQ ID NO: 69590 - DNA, 18 bp, Artificial Sequence
  Synthetic DNA
tatcatgacacactaatg

SEQ ID NO: 69591 - DNA, 18 bp, Artificial Sequence
  Synthetic DNA
tatcatgactcattaaag

SEQ ID NO: 69592 - DNA, 18 bp, Artificial Sequence
  Synthetic DNA
tatcatgactctctattg

SEQ ID NO: 69593 - DNA, 18 bp, Artificial Sequence
  Synthetic DNA
tatctcaaattactgtag

SEQ ID NO: 69594 - DNA, 18 bp, Artificial Sequence
  Synthetic DNA
tatctcaactcattatag

SEQ ID NO: 69595 - DNA, 18 bp, Artificial Sequence
  Synthetic DNA
tatctcgactaactattg

SEQ ID NO: 69596 - DNA, 18 bp, Artificial Sequence
  Synthetic DNA
tatgttgacttactgaag

SEQ ID NO: 69597 - DNA, 18 bp, Artificial Sequence
  Synthetic DNA
tattaaaactctcaatag

SEQ ID NO: 69598 - DNA, 18 bp, Artificial Sequence
  Synthetic DNA
tattaaaactctctctag

SEQ ID NO: 69599 - DNA, 18 bp, Artificial Sequence
  Synthetic DNA
tattaagacacactacgg

SEQ ID NO: 69600 - DNA, 18 bp, Artificial Sequence
  Synthetic DNA
tattaagactaaatttag

SEQ ID NO: 69601 - DNA, 18 bp, Artificial Sequence
  Synthetic DNA
tattaagcaattttatag

SEQ ID NO: 69602 - DNA, 18 bp, Artificial Sequence
  Synthetic DNA
tattaaggtacactttag

SEQ ID NO: 69603 - DNA, 18 bp, Artificial Sequence
  Synthetic DNA
tattaagtctcacaattg

SEQ ID NO: 69604 - DNA, 18 bp, Artificial Sequence
  Synthetic DNA
tattacaacactctgtag

SEQ ID NO: 69605 - DNA, 18 bp, Artificial Sequence
  Synthetic DNA
tattacaacacttgatag

SEQ ID NO: 69606 - DNA, 18 bp, Artificial Sequence
  Synthetic DNA
tattacaacccataatag

SEQ ID NO: 69607 - DNA, 18 bp, Artificial Sequence
  Synthetic DNA
tattacaagtcacttttg

SEQ ID NO: 69608 - DNA, 18 bp, Artificial Sequence
  Synthetic DNA
tattacacgtctcttttg

SEQ ID NO: 69609 - DNA, 18 bp, Artificial Sequence
  Synthetic DNA
tattaccaggctcagtag

SEQ ID NO: 69610 - DNA, 18 bp, Artificial Sequence
  Synthetic DNA
tattacgaaccataacag

SEQ ID NO: 69611 - DNA, 18 bp, Artificial Sequence
  Synthetic DNA
tattacgacactccaacg

SEQ ID NO: 69612 - DNA, 18 bp, Artificial Sequence
  Synthetic DNA
tattacgactatatattg

SEQ ID NO: 69613 - DNA, 18 bp, Artificial Sequence
  Synthetic DNA
tattacgactcaaataag

SEQ ID NO: 69614 - DNA, 18 bp, Artificial Sequence
  Synthetic DNA
tattacgactccattttg

SEQ ID NO: 69615 - DNA, 18 bp, Artificial Sequence
  Synthetic DNA
tattacgactctcggtcg

SEQ ID NO: 69616 - DNA, 18 bp, Artificial Sequence
  Synthetic DNA
tattacgactttctaatg

SEQ ID NO: 69617 - DNA, 18 bp, Artificial Sequence
  Synthetic DNA
tattacgagactcaatgg

SEQ ID NO: 69618 - DNA, 18 bp, Artificial Sequence
  Synthetic DNA
tattacgagtctttaaag

SEQ ID NO: 69619 - DNA, 18 bp, Artificial Sequence
  Synthetic DNA
tattacgatgatctctag

SEQ ID NO: 69620 - DNA, 18 bp, Artificial Sequence
  Synthetic DNA
tattacgtatcacttaag

SEQ ID NO: 69621 - DNA, 18 bp, Artificial Sequence
  Synthetic DNA
tattacgtctctttagag

SEQ ID NO: 69622 - DNA, 18 bp, Artificial Sequence
  Synthetic DNA
tattacgtgacacaatag

SEQ ID NO: 69623 - DNA, 18 bp, Artificial Sequence
  Synthetic DNA
tattacgtgtcgctatcg

SEQ ID NO: 69624 - DNA, 18 bp, Artificial Sequence
  Synthetic DNA
tattacgttttactaaag

SEQ ID NO: 69625 - DNA, 18 bp, Artificial Sequence
  Synthetic DNA
tattactaatcacataag

SEQ ID NO: 69626 - DNA, 18 bp, Artificial Sequence
  Synthetic DNA
tattactaatttctttag

SEQ ID NO: 69627 - DNA, 18 bp, Artificial Sequence
  Synthetic DNA
tattactactctcaattg

SEQ ID NO: 69628 - DNA, 18 bp, Artificial Sequence
  Synthetic DNA
tattactatccattctag

SEQ ID NO: 69629 - DNA, 18 bp, Artificial Sequence
  Synthetic DNA
tattactccacactaaag

SEQ ID NO: 69630 - DNA, 18 bp, Artificial Sequence
  Synthetic DNA
tattactcctcattattg

SEQ ID NO: 69631 - DNA, 18 bp, Artificial Sequence
  Synthetic DNA
tattacttctcacttttg

SEQ ID NO: 69632 - DNA, 18 bp, Artificial Sequence
  Synthetic DNA
tattacttctcgctttag

SEQ ID NO: 69633 - DNA, 18 bp, Artificial Sequence
  Synthetic DNA
tattaggacctactacag

SEQ ID NO: 69634 - DNA, 18 bp, Artificial Sequence
  Synthetic DNA
tattaggagtcaacttag

SEQ ID NO: 69635 - DNA, 18 bp, Artificial Sequence
  Synthetic DNA
tattaggcctcacaaaag

SEQ ID NO: 69636 - DNA, 18 bp, Artificial Sequence
  Synthetic DNA
tattataactcagaatag

SEQ ID NO: 69637 - DNA, 18 bp, Artificial Sequence
  Synthetic DNA
tattatcacactcgatag

SEQ ID NO: 69638 - DNA, 18 bp, Artificial Sequence
  Synthetic DNA
tattatctttcattatcg

SEQ ID NO: 69639 - DNA, 18 bp, Artificial Sequence
  Synthetic DNA
tattatgactcattaatg

SEQ ID NO: 69640 - DNA, 18 bp, Artificial Sequence
  Synthetic DNA
tattatgtctcaccacag

SEQ ID NO: 69641 - DNA, 18 bp, Artificial Sequence
  Synthetic DNA
tattatgtctcacttttg

SEQ ID NO: 69642 - DNA, 18 bp, Artificial Sequence
  Synthetic DNA
tattattacacacaattg

SEQ ID NO: 69643 - DNA, 18 bp, Artificial Sequence
  Synthetic DNA
tattccctacctcaattg

SEQ ID NO: 69644 - DNA, 18 bp, Artificial Sequence
  Synthetic DNA
tattccgcctttcaaaag

SEQ ID NO: 69645 - DNA, 18 bp, Artificial Sequence
  Synthetic DNA
tattcctagacattatag

SEQ ID NO: 69646 - DNA, 18 bp, Artificial Sequence
  Synthetic DNA
tatttcaactttctatag

SEQ ID NO: 69647 - DNA, 18 bp, Artificial Sequence
  Synthetic DNA
tatttccactgactattg

SEQ ID NO: 69648 - DNA, 18 bp, Artificial Sequence
  Synthetic DNA
tatttcgaatctctttag

SEQ ID NO: 69649 - DNA, 18 bp, Artificial Sequence
  Synthetic DNA
tatttcgactcacttctg

SEQ ID NO: 69650 - DNA, 18 bp, Artificial Sequence
  Synthetic DNA
tatttcgacttaatatgg

SEQ ID NO: 69651 - DNA, 18 bp, Artificial Sequence
  Synthetic DNA
tatttcgatttacaatag

SEQ ID NO: 69652 - DNA, 18 bp, Artificial Sequence
  Synthetic DNA
tatttcgcctctcaatag

SEQ ID NO: 69653 - DNA, 18 bp, Artificial Sequence
  Synthetic DNA
tatttcgtatcacaattg

SEQ ID NO: 69654 - DNA, 18 bp, Artificial Sequence
  Synthetic DNA
tatttcgtctcactaatg

SEQ ID NO: 69655 - DNA, 18 bp, Artificial Sequence
  Synthetic DNA
tatttctacttacaatag

SEQ ID NO: 69656 - DNA, 18 bp, Artificial Sequence
  Synthetic DNA
tatttctacttacattag

SEQ ID NO: 69657 - DNA, 18 bp, Artificial Sequence
  Synthetic DNA
tatttctcctcacttgag

SEQ ID NO: 69658 - DNA, 18 bp, Artificial Sequence
  Synthetic DNA
tcaaacgactcatgttcg

SEQ ID NO: 69659 - DNA, 18 bp, Artificial Sequence
  Synthetic DNA
tcaaacgttttacagtag

SEQ ID NO: 69660 - DNA, 18 bp, Artificial Sequence
  Synthetic DNA
tcaatcgactcatcttag

SEQ ID NO: 69661 - DNA, 18 bp, Artificial Sequence
  Synthetic DNA
tcacacggcttactaaag

SEQ ID NO: 69662 - DNA, 18 bp, Artificial Sequence
  Synthetic DNA
tcacaggcttagctacag

SEQ ID NO: 69663 - DNA, 18 bp, Artificial Sequence
  Synthetic DNA
tcactcgccgcactatag

SEQ ID NO: 69664 - DNA, 18 bp, Artificial Sequence
  Synthetic DNA
tcataatatttactatag

SEQ ID NO: 69665 - DNA, 18 bp, Artificial Sequence
  Synthetic DNA
tcatacctctcgctttgg

SEQ ID NO: 69666 - DNA, 18 bp, Artificial Sequence
  Synthetic DNA
tcatacgacagacttttg

SEQ ID NO: 69667 - DNA, 18 bp, Artificial Sequence
  Synthetic DNA
tcatacgacttatttatg

SEQ ID NO: 69668 - DNA, 18 bp, Artificial Sequence
  Synthetic DNA
tcatacgatccaataaag

SEQ ID NO: 69669 - DNA, 18 bp, Artificial Sequence
  Synthetic DNA
tcatactactcacagttg

SEQ ID NO: 69670 - DNA, 18 bp, Artificial Sequence
  Synthetic DNA
tcatactactcgcttaag

SEQ ID NO: 69671 - DNA, 18 bp, Artificial Sequence
  Synthetic DNA
tcatactatatgctaaag

SEQ ID NO: 69672 - DNA, 18 bp, Artificial Sequence
  Synthetic DNA
tcatataactaacaattg

SEQ ID NO: 69673 - DNA, 18 bp, Artificial Sequence
  Synthetic DNA
tcatatcgctcacaaaag

SEQ ID NO: 69674 - DNA, 18 bp, Artificial Sequence
  Synthetic DNA
tcatatgaatctccatag

SEQ ID NO: 69675 - DNA, 18 bp, Artificial Sequence
  Synthetic DNA
tcatccatctcactacag

SEQ ID NO: 69676 - DNA, 18 bp, Artificial Sequence
  Synthetic DNA
tcatccgagatactctag

SEQ ID NO: 69677 - DNA, 18 bp, Artificial Sequence
  Synthetic DNA
tcatctgtctcaccatag

SEQ ID NO: 69678 - DNA, 18 bp, Artificial Sequence
  Synthetic DNA
tcatgaggctcacattag

SEQ ID NO: 69679 - DNA, 18 bp, Artificial Sequence
  Synthetic DNA
tcatgggactctctacag

SEQ ID NO: 69680 - DNA, 18 bp, Artificial Sequence
  Synthetic DNA
tcattagtctcgcagatg

SEQ ID NO: 69681 - DNA, 18 bp, Artificial Sequence
  Synthetic DNA
tcattcgactttctacag

SEQ ID NO: 69682 - DNA, 18 bp, Artificial Sequence
  Synthetic DNA
tcattcgtcctgttatag

SEQ ID NO: 69683 - DNA, 18 bp, Artificial Sequence
  Synthetic DNA
tcatttgacacgcgatag

SEQ ID NO: 69684 - DNA, 18 bp, Artificial Sequence
  Synthetic DNA
tccaacgaccctttatag

SEQ ID NO: 69685 - DNA, 18 bp, Artificial Sequence
  Synthetic DNA
tccaacgtctctctatag

SEQ ID NO: 69686 - DNA, 18 bp, Artificial Sequence
  Synthetic DNA
tcctacgagtgtcatccg

SEQ ID NO: 69687 - DNA, 18 bp, Artificial Sequence
  Synthetic DNA
tcgaacgacacactaacg

SEQ ID NO: 69688 - DNA, 18 bp, Artificial Sequence
  Synthetic DNA
tctaacaactcactattg

SEQ ID NO: 69689 - DNA, 18 bp, Artificial Sequence
  Synthetic DNA
tctaacaactcactttag

SEQ ID NO: 69690 - DNA, 18 bp, Artificial Sequence
  Synthetic DNA
tctaacgactctctaacg

SEQ ID NO: 69691 - DNA, 18 bp, Artificial Sequence
  Synthetic DNA
tctcaagtctcacttttg

SEQ ID NO: 69692 - DNA, 18 bp, Artificial Sequence
  Synthetic DNA
tctgactacagacaattg

SEQ ID NO: 69693 - DNA, 18 bp, Artificial Sequence
  Synthetic DNA
tcttacaacactctatag

SEQ ID NO: 69694 - DNA, 18 bp, Artificial Sequence
  Synthetic DNA
tcttaccattcactcccg

SEQ ID NO: 69695 - DNA, 18 bp, Artificial Sequence
  Synthetic DNA
tcttacttcatactatag

SEQ ID NO: 69696 - DNA, 18 bp, Artificial Sequence
  Synthetic DNA
tctttctactctctctag

SEQ ID NO: 69697 - DNA, 18 bp, Artificial Sequence
  Synthetic DNA
tgaaacgacacaataacg

SEQ ID NO: 69698 - DNA, 18 bp, Artificial Sequence
  Synthetic DNA
tgaaacgagtcaccatcg

SEQ ID NO: 69699 - DNA, 18 bp, Artificial Sequence
  Synthetic DNA
tgaaccgacacacgagag

SEQ ID NO: 69700 - DNA, 18 bp, Artificial Sequence
  Synthetic DNA
tgaaccttctttctatag

SEQ ID NO: 69701 - DNA, 18 bp, Artificial Sequence
  Synthetic DNA
tgaatggactcaccaaag

SEQ ID NO: 69702 - DNA, 18 bp, Artificial Sequence
  Synthetic DNA
tgacacttcacactatag

SEQ ID NO: 69703 - DNA, 18 bp, Artificial Sequence
  Synthetic DNA
tgatacaaatcaaaatag

SEQ ID NO: 69704 - DNA, 18 bp, Artificial Sequence
  Synthetic DNA
tgatacaacttatcatag

SEQ ID NO: 69705 - DNA, 18 bp, Artificial Sequence
  Synthetic DNA
tgatacgaatcatttttg

SEQ ID NO: 69706 - DNA, 18 bp, Artificial Sequence
  Synthetic DNA
tgatacgacttgcaattg

SEQ ID NO: 69707 - DNA, 18 bp, Artificial Sequence
  Synthetic DNA
tgatacgactttcaaagg

SEQ ID NO: 69708 - DNA, 18 bp, Artificial Sequence
  Synthetic DNA
tgatacgagtgacgttgg

SEQ ID NO: 69709 - DNA, 18 bp, Artificial Sequence
  Synthetic DNA
tgatacgagtgactaatg

SEQ ID NO: 69710 - DNA, 18 bp, Artificial Sequence
  Synthetic DNA
tgatacgattcattcaag

SEQ ID NO: 69711 - DNA, 18 bp, Artificial Sequence
  Synthetic DNA
tgatactaatccctttag

SEQ ID NO: 69712 - DNA, 18 bp, Artificial Sequence
  Synthetic DNA
tgatactacacacctgag

SEQ ID NO: 69713 - DNA, 18 bp, Artificial Sequence
  Synthetic DNA
tgatactacacgctaaag

SEQ ID NO: 69714 - DNA, 18 bp, Artificial Sequence
  Synthetic DNA
tgataggactgtctatgg

SEQ ID NO: 69715 - DNA, 18 bp, Artificial Sequence
  Synthetic DNA
tgatatgtcactctatag

SEQ ID NO: 69716 - DNA, 18 bp, Artificial Sequence
  Synthetic DNA
tgatccgtatctctatag

SEQ ID NO: 69717 - DNA, 18 bp, Artificial Sequence
  Synthetic DNA
tgatgcgactaactactg

SEQ ID NO: 69718 - DNA, 18 bp, Artificial Sequence
  Synthetic DNA
tgatgcgccccaataaag

SEQ ID NO: 69719 - DNA, 18 bp, Artificial Sequence
  Synthetic DNA
tgattcaactccttctag

SEQ ID NO: 69720 - DNA, 18 bp, Artificial Sequence
  Synthetic DNA
tgattcgaatttcgatgg

SEQ ID NO: 69721 - DNA, 18 bp, Artificial Sequence
  Synthetic DNA
tgattcgtttccctatag

SEQ ID NO: 69722 - DNA, 18 bp, Artificial Sequence
  Synthetic DNA
tgcaacgactcacctttg

SEQ ID NO: 69723 - DNA, 18 bp, Artificial Sequence
  Synthetic DNA
tgctactacacccaattg

SEQ ID NO: 69724 - DNA, 18 bp, Artificial Sequence
  Synthetic DNA
tggaaccaatcgctttag

SEQ ID NO: 69725 - DNA, 18 bp, Artificial Sequence
  Synthetic DNA
tggtacaccactctatag

SEQ ID NO: 69726 - DNA, 18 bp, Artificial Sequence
  Synthetic DNA
tgttacgagtcactaatg

SEQ ID NO: 69727 - DNA, 18 bp, Artificial Sequence
  Synthetic DNA
tgttacgtcttactaaag

SEQ ID NO: 69728 - DNA, 18 bp, Artificial Sequence
  Synthetic DNA
tgttactacaccttatgg

SEQ ID NO: 69729 - DNA, 18 bp, Artificial Sequence
  Synthetic DNA
tgttactattgacaatag

SEQ ID NO: 69730 - DNA, 18 bp, Artificial Sequence
  Synthetic DNA
tgttaggatttactattg

SEQ ID NO: 69731 - DNA, 18 bp, Artificial Sequence
  Synthetic DNA
tgttatgcgttactttag

SEQ ID NO: 69732 - DNA, 18 bp, Artificial Sequence
  Synthetic DNA
tgttgggaatcactatag

SEQ ID NO: 69733 - DNA, 18 bp, Artificial Sequence
  Synthetic DNA
ttaaaaaactcactatcg

SEQ ID NO: 69734 - DNA, 18 bp, Artificial Sequence
  Synthetic DNA
ttaaaagacgaattgtag

SEQ ID NO: 69735 - DNA, 18 bp, Artificial Sequence
  Synthetic DNA
ttaaaatacttcctatag

SEQ ID NO: 69736 - DNA, 18 bp, Artificial Sequence
  Synthetic DNA
ttaaacaattcacactag

SEQ ID NO: 69737 - DNA, 18 bp, Artificial Sequence
  Synthetic DNA
ttaaacgaaccactaaag

SEQ ID NO: 69738 - DNA, 18 bp, Artificial Sequence
  Synthetic DNA
ttaaacgattctatgtag

SEQ ID NO: 69739 - DNA, 18 bp, Artificial Sequence
  Synthetic DNA
ttaaaggacctactatag

SEQ ID NO: 69740 - DNA, 18 bp, Artificial Sequence
  Synthetic DNA
ttaaaggcctaactattg

SEQ ID NO: 69741 - DNA, 18 bp, Artificial Sequence
  Synthetic DNA
ttaagccactcactaggg

SEQ ID NO: 69742 - DNA, 18 bp, Artificial Sequence
  Synthetic DNA
ttaatcatctcactatag

SEQ ID NO: 69743 - DNA, 18 bp, Artificial Sequence
  Synthetic DNA
ttaatccagtctctatag

SEQ ID NO: 69744 - DNA, 18 bp, Artificial Sequence
  Synthetic DNA
ttaatctactcactaatg

SEQ ID NO: 69745 - DNA, 18 bp, Artificial Sequence
  Synthetic DNA
ttaatggaatttctatag

SEQ ID NO: 69746 - DNA, 18 bp, Artificial Sequence
  Synthetic DNA
ttacaccccgaactatag

SEQ ID NO: 69747 - DNA, 18 bp, Artificial Sequence
  Synthetic DNA
ttacacgacacaccattg

SEQ ID NO: 69748 - DNA, 18 bp, Artificial Sequence
  Synthetic DNA
ttacatcactcactatgg

SEQ ID NO: 69749 - DNA, 18 bp, Artificial Sequence
  Synthetic DNA
ttacatgtctcactttag

SEQ ID NO: 69750 - DNA, 18 bp, Artificial Sequence
  Synthetic DNA
ttacatgtctcactttgg

SEQ ID NO: 69751 - DNA, 18 bp, Artificial Sequence
  Synthetic DNA
ttacattactcaatacag

SEQ ID NO: 69752 - DNA, 18 bp, Artificial Sequence
  Synthetic DNA
ttagacaatccactagag

SEQ ID NO: 69753 - DNA, 18 bp, Artificial Sequence
  Synthetic DNA
ttagactactccctaacg

SEQ ID NO: 69754 - DNA, 18 bp, Artificial Sequence
  Synthetic DNA
ttataaaacacactgtag

SEQ ID NO: 69755 - DNA, 18 bp, Artificial Sequence
  Synthetic DNA
ttataaaattcgcactag

SEQ ID NO: 69756 - DNA, 18 bp, Artificial Sequence
  Synthetic DNA
ttataacactaactatcg

SEQ ID NO: 69757 - DNA, 18 bp, Artificial Sequence
  Synthetic DNA
ttataagtcccactattg

SEQ ID NO: 69758 - DNA, 18 bp, Artificial Sequence
  Synthetic DNA
ttataatactaactctag

SEQ ID NO: 69759 - DNA, 18 bp, Artificial Sequence
  Synthetic DNA
ttatacaacttacattag

SEQ ID NO: 69760 - DNA, 18 bp, Artificial Sequence
  Synthetic DNA
ttatacaattcagtttag

SEQ ID NO: 69761 - DNA, 18 bp, Artificial Sequence
  Synthetic DNA
ttataccactcagaagag

SEQ ID NO: 69762 - DNA, 18 bp, Artificial Sequence
  Synthetic DNA
ttatacgaatcaagatcg

SEQ ID NO: 69763 - DNA, 18 bp, Artificial Sequence
  Synthetic DNA
ttatacgaatctataatg

SEQ ID NO: 69764 - DNA, 18 bp, Artificial Sequence
  Synthetic DNA
ttatacgaatgaatactg

SEQ ID NO: 69765 - DNA, 18 bp, Artificial Sequence
  Synthetic DNA
ttatacgacaatctactg

SEQ ID NO: 69766 - DNA, 18 bp, Artificial Sequence
  Synthetic DNA
ttatacgacacacacaag

SEQ ID NO: 69767 - DNA, 18 bp, Artificial Sequence
  Synthetic DNA
ttatacgacacgctgttg

SEQ ID NO: 69768 - DNA, 18 bp, Artificial Sequence
  Synthetic DNA
ttatacgacataataaag

SEQ ID NO: 69769 - DNA, 18 bp, Artificial Sequence
  Synthetic DNA
ttatacgacatactatca

SEQ ID NO: 69770 - DNA, 18 bp, Artificial Sequence
  Synthetic DNA
ttatacgactcttcaaag

SEQ ID NO: 69771 - DNA, 18 bp, Artificial Sequence
  Synthetic DNA
ttatacgactggctcaag

SEQ ID NO: 69772 - DNA, 18 bp, Artificial Sequence
  Synthetic DNA
ttatacgacttatttttg

SEQ ID NO: 69773 - DNA, 18 bp, Artificial Sequence
  Synthetic DNA
ttatacgagtctcttaag

SEQ ID NO: 69774 - DNA, 18 bp, Artificial Sequence
  Synthetic DNA
ttatacgatacaatactg

SEQ ID NO: 69775 - DNA, 18 bp, Artificial Sequence
  Synthetic DNA
ttatacgattcacaaatg

SEQ ID NO: 69776 - DNA, 18 bp, Artificial Sequence
  Synthetic DNA
ttatacgattctctaatg

SEQ ID NO: 69777 - DNA, 18 bp, Artificial Sequence
  Synthetic DNA
ttatacgccttattttag

SEQ ID NO: 69778 - DNA, 18 bp, Artificial Sequence
  Synthetic DNA
ttatacgtcacaaaatag

SEQ ID NO: 69779 - DNA, 18 bp, Artificial Sequence
  Synthetic DNA
ttatacgtctaacaaaag

SEQ ID NO: 69780 - DNA, 18 bp, Artificial Sequence
  Synthetic DNA
ttatacgtttcattttag

SEQ ID NO: 69781 - DNA, 18 bp, Artificial Sequence
  Synthetic DNA
ttatactacacagaacag

SEQ ID NO: 69782 - DNA, 18 bp, Artificial Sequence
  Synthetic DNA
ttatactacactttatag

SEQ ID NO: 69783 - DNA, 18 bp, Artificial Sequence
  Synthetic DNA
ttatactactcaattttg

SEQ ID NO: 69784 - DNA, 18 bp, Artificial Sequence
  Synthetic DNA
ttatactatctactatag

SEQ ID NO: 69785 - DNA, 18 bp, Artificial Sequence
  Synthetic DNA
ttatacttctcaaaatag

SEQ ID NO: 69786 - DNA, 18 bp, Artificial Sequence
  Synthetic DNA
ttatacttttctctttag

SEQ ID NO: 69787 - DNA, 18 bp, Artificial Sequence
  Synthetic DNA
ttatagcaatcactatgg

SEQ ID NO: 69788 - DNA, 18 bp, Artificial Sequence
  Synthetic DNA
ttataggtctcattaatg

SEQ ID NO: 69789 - DNA, 18 bp, Artificial Sequence
  Synthetic DNA
ttatataaatcactttag

SEQ ID NO: 69790 - DNA, 18 bp, Artificial Sequence
  Synthetic DNA
ttatatgaatctcttttg

SEQ ID NO: 69791 - DNA, 18 bp, Artificial Sequence
  Synthetic DNA
ttatatgacttaaaatag

SEQ ID NO: 69792 - DNA, 18 bp, Artificial Sequence
  Synthetic DNA
ttatatgtctcacaacag

SEQ ID NO: 69793 - DNA, 18 bp, Artificial Sequence
  Synthetic DNA
ttatcccaactagtatag

SEQ ID NO: 69794 - DNA, 18 bp, Artificial Sequence
  Synthetic DNA
ttatccgacacagtttgg

SEQ ID NO: 69795 - DNA, 18 bp, Artificial Sequence
  Synthetic DNA
ttatccgactctatattg

SEQ ID NO: 69796 - DNA, 18 bp, Artificial Sequence
  Synthetic DNA
ttatccgacttagttttg

SEQ ID NO: 69797 - DNA, 18 bp, Artificial Sequence
  Synthetic DNA
ttatccgtcactctatag

SEQ ID NO: 69798 - DNA, 18 bp, Artificial Sequence
  Synthetic DNA
ttatccgtcttacaattg

SEQ ID NO: 69799 - DNA, 18 bp, Artificial Sequence
  Synthetic DNA
ttatctaaatcacactag

SEQ ID NO: 69800 - DNA, 18 bp, Artificial Sequence
  Synthetic DNA
ttatgatacatactgatg

SEQ ID NO: 69801 - DNA, 18 bp, Artificial Sequence
  Synthetic DNA
ttatgcgactaaccctag

SEQ ID NO: 69802 - DNA, 18 bp, Artificial Sequence
  Synthetic DNA
ttatgcgactcactgctg

SEQ ID NO: 69803 - DNA, 18 bp, Artificial Sequence
  Synthetic DNA
ttatgcgtctcgctttag

SEQ ID NO: 69804 - DNA, 18 bp, Artificial Sequence
  Synthetic DNA
ttatgcgtgttactttag

SEQ ID NO: 69805 - DNA, 18 bp, Artificial Sequence
  Synthetic DNA
ttatgggactcacgctag

SEQ ID NO: 69806 - DNA, 18 bp, Artificial Sequence
  Synthetic DNA
ttatgggactcacttaag

SEQ ID NO: 69807 - DNA, 18 bp, Artificial Sequence
  Synthetic DNA
ttattagactatctattg

SEQ ID NO: 69808 - DNA, 18 bp, Artificial Sequence
  Synthetic DNA
ttattcatctcacattag

SEQ ID NO: 69809 - DNA, 18 bp, Artificial Sequence
  Synthetic DNA
ttattcatgtctcaatag

SEQ ID NO: 69810 - DNA, 18 bp, Artificial Sequence
  Synthetic DNA
ttattcgaatcactaatg

SEQ ID NO: 69811 - DNA, 18 bp, Artificial Sequence
  Synthetic DNA
ttattcgactaaccattg

SEQ ID NO: 69812 - DNA, 18 bp, Artificial Sequence
  Synthetic DNA
ttattcgtctcaaaatag

SEQ ID NO: 69813 - DNA, 18 bp, Artificial Sequence
  Synthetic DNA
ttattctaatcacaatag

SEQ ID NO: 69814 - DNA, 18 bp, Artificial Sequence
  Synthetic DNA
ttattggacgcactaaag

SEQ ID NO: 69815 - DNA, 18 bp, Artificial Sequence
  Synthetic DNA
ttattgttctcactatag

SEQ ID NO: 69816 - DNA, 18 bp, Artificial Sequence
  Synthetic DNA
ttatttaattcattatcg

SEQ ID NO: 69817 - DNA, 18 bp, Artificial Sequence
  Synthetic DNA
ttcaaggactctcctatg

SEQ ID NO: 69818 - DNA, 18 bp, Artificial Sequence
  Synthetic DNA
ttcaccgattttctgttg

SEQ ID NO: 69819 - DNA, 18 bp, Artificial Sequence
  Synthetic DNA
ttcatctattccctatag

SEQ ID NO: 69820 - DNA, 18 bp, Artificial Sequence
  Synthetic DNA
ttccaccagttagtatag

SEQ ID NO: 69821 - DNA, 18 bp, Artificial Sequence
  Synthetic DNA
ttctacctcctattatag

SEQ ID NO: 69822 - DNA, 18 bp, Artificial Sequence
  Synthetic DNA
ttctacgtctcaatctag

SEQ ID NO: 69823 - DNA, 18 bp, Artificial Sequence
  Synthetic DNA
ttctacgtctctctttag

SEQ ID NO: 69824 - DNA, 18 bp, Artificial Sequence
  Synthetic DNA
ttctacgtcttacgagag

SEQ ID NO: 69825 - DNA, 18 bp, Artificial Sequence
  Synthetic DNA
ttctactactcattaaag

SEQ ID NO: 69826 - DNA, 18 bp, Artificial Sequence
  Synthetic DNA
ttgattggctcactttag

SEQ ID NO: 69827 - DNA, 18 bp, Artificial Sequence
  Synthetic DNA
ttgtaccacttagaatag

SEQ ID NO: 69828 - DNA, 18 bp, Artificial Sequence
  Synthetic DNA
ttgtacgaataactattg

SEQ ID NO: 69829 - DNA, 18 bp, Artificial Sequence
  Synthetic DNA
ttgtacgatttattatag

SEQ ID NO: 69830 - DNA, 18 bp, Artificial Sequence
  Synthetic DNA
ttgtacgtcaaatcattg

SEQ ID NO: 69831 - DNA, 18 bp, Artificial Sequence
  Synthetic DNA
ttgtacgtcaatttctag

SEQ ID NO: 69832 - DNA, 18 bp, Artificial Sequence
  Synthetic DNA
ttgtacgtctcacattag

SEQ ID NO: 69833 - DNA, 18 bp, Artificial Sequence
  Synthetic DNA
ttgtactacttacaaaag

SEQ ID NO: 69834 - DNA, 18 bp, Artificial Sequence
  Synthetic DNA
ttgtactgctctcaatgg

SEQ ID NO: 69835 - DNA, 18 bp, Artificial Sequence
  Synthetic DNA
ttgtgcgtctcactaaag

SEQ ID NO: 69836 - DNA, 18 bp, Artificial Sequence
  Synthetic DNA
ttgttctacactctattg

SEQ ID NO: 69837 - DNA, 18 bp, Artificial Sequence
  Synthetic DNA
tttaacgactcaaaatgg

SEQ ID NO: 69838 - DNA, 18 bp, Artificial Sequence
  Synthetic DNA
tttaacgtctaactatag

SEQ ID NO: 69839 - DNA, 18 bp, Artificial Sequence
  Synthetic DNA
tttaccgtgtcaccgtag

SEQ ID NO: 69840 - DNA, 18 bp, Artificial Sequence
  Synthetic DNA
tttcacgactctgtatag

SEQ ID NO: 69841 - DNA, 18 bp, Artificial Sequence
  Synthetic DNA
tttggcgtcacactattg

SEQ ID NO: 69842 - DNA, 18 bp, Artificial Sequence
  Synthetic DNA
tttgtctattcactaaag

SEQ ID NO: 69843 - DNA, 18 bp, Artificial Sequence
  Synthetic DNA
ttttaaaactcagtatag

SEQ ID NO: 69844 - DNA, 18 bp, Artificial Sequence
  Synthetic DNA
ttttaccactcacaaaag

SEQ ID NO: 69845 - DNA, 18 bp, Artificial Sequence
  Synthetic DNA
ttttacctctcactttag

SEQ ID NO: 69846 - DNA, 18 bp, Artificial Sequence
  Synthetic DNA
ttttacgacacacttaag

SEQ ID NO: 69847 - DNA, 18 bp, Artificial Sequence
  Synthetic DNA
ttttacgacgcgctttag

SEQ ID NO: 69848 - DNA, 18 bp, Artificial Sequence
  Synthetic DNA
ttttacgcctcgctatgg

SEQ ID NO: 69849 - DNA, 18 bp, Artificial Sequence
  Synthetic DNA
ttttacgtcacaataaag

SEQ ID NO: 69850 - DNA, 18 bp, Artificial Sequence
  Synthetic DNA
ttttacgtctcaaaatag

SEQ ID NO: 69851 - DNA, 18 bp, Artificial Sequence
  Synthetic DNA
ttttacgtctcaaattag

SEQ ID NO: 69852 - DNA, 18 bp, Artificial Sequence
  Synthetic DNA
ttttacgtttctctattg

SEQ ID NO: 69853 - DNA, 18 bp, Artificial Sequence
  Synthetic DNA
ttttactcctcactactg

SEQ ID NO: 69854 - DNA, 18 bp, Artificial Sequence
  Synthetic DNA
ttttagaaatcactatag

SEQ ID NO: 69855 - DNA, 18 bp, Artificial Sequence
  Synthetic DNA
ttttccgactctcctttg

SEQ ID NO: 69856 - DNA, 18 bp, Artificial Sequence
  Synthetic DNA
ttttgcgactatctatag

SEQ ID NO: 69857 - DNA, 18 bp, Artificial Sequence
  Synthetic DNA
tttttcccctcactatag

SEQ ID NO: 69858 - DNA, 18 bp, Artificial Sequence
  Synthetic DNA
aaagatgacatactaaag

SEQ ID NO: 69859 - DNA, 18 bp, Artificial Sequence
  Synthetic DNA
atattcgtctcacaatag

SEQ ID NO: 69860 - DNA, 18 bp, Artificial Sequence
  Synthetic DNA
taatacgattctcccgag

SEQ ID NO: 69861 - DNA, 18 bp, Artificial Sequence
  Synthetic DNA
taatacgccacattcttg

SEQ ID NO: 69862 - DNA, 18 bp, Artificial Sequence
  Synthetic DNA
taatattactcacttacg

SEQ ID NO: 69863 - DNA, 18 bp, Artificial Sequence
  Synthetic DNA
taattcgacactctaatg

SEQ ID NO: 69864 - DNA, 18 bp, Artificial Sequence
  Synthetic DNA
taattcgattcacaaatg

SEQ ID NO: 69865 - DNA, 18 bp, Artificial Sequence
  Synthetic DNA
taattcgtctctatattg

SEQ ID NO: 69866 - DNA, 18 bp, Artificial Sequence
  Synthetic DNA
tatcccgacttacaatag

SEQ ID NO: 69867 - DNA, 18 bp, Artificial Sequence
  Synthetic DNA
tattacgacatgttcaag

SEQ ID NO: 69868 - DNA, 18 bp, Artificial Sequence
  Synthetic DNA
tattacgtcaaactttag

SEQ ID NO: 69869 - DNA, 18 bp, Artificial Sequence
  Synthetic DNA
tttaacgactcacgttag

SEQ ID NO: 69870 - DNA, 18 bp, Artificial Sequence
  Synthetic DNA
taatccgacactgttcag

SEQ ID NO: 69871 - DNA, 18 bp, Artificial Sequence
  Synthetic DNA
taattcgtttctcaatag

SEQ ID NO: 69872 - DNA, 18 bp, Artificial Sequence
  Synthetic DNA
tattaaaactcacattag

SEQ ID NO: 69873 - DNA, 18 bp, Artificial Sequence
  Synthetic DNA
tattacatcagactatag

SEQ ID NO: 69874 - DNA, 18 bp, Artificial Sequence
  Synthetic DNA
tattacgactcgcttatg

SEQ ID NO: 69875 - DNA, 18 bp, Artificial Sequence
  Synthetic DNA
tattacgtttcacttaag

SEQ ID NO: 69876 - DNA, 18 bp, Artificial Sequence
  Synthetic DNA
ttaatctactcacaatag

SEQ ID NO: 69877 - DNA, 18 bp, Artificial Sequence
  Synthetic DNA
ttatacgactctcacaag

SEQ ID NO: 69878 - DNA, 18 bp, Artificial Sequence
  Synthetic DNA
ttattcgtctctcaatag

SEQ ID NO: 69879 - DNA, 18 bp, Artificial Sequence
  Synthetic DNA
aaaaaagactcactgttg

SEQ ID NO: 69880 - DNA, 18 bp, Artificial Sequence
  Synthetic DNA
aaaaacgacttcatatag

SEQ ID NO: 69881 - DNA, 18 bp, Artificial Sequence
  Synthetic DNA
aaaaacgccacactattg

SEQ ID NO: 69882 - DNA, 18 bp, Artificial Sequence
  Synthetic DNA
aaaaacggctctctacag

SEQ ID NO: 69883 - DNA, 18 bp, Artificial Sequence
  Synthetic DNA
aaaaatgagtaaccatag

SEQ ID NO: 69884 - DNA, 18 bp, Artificial Sequence
  Synthetic DNA
aaaatcaactctcaatag

SEQ ID NO: 69885 - DNA, 18 bp, Artificial Sequence
  Synthetic DNA
aaaatcgaatcaccatag

SEQ ID NO: 69886 - DNA, 18 bp, Artificial Sequence
  Synthetic DNA
aaacacgactctacattg

SEQ ID NO: 69887 - DNA, 18 bp, Artificial Sequence
  Synthetic DNA
aaacactactcattctcg

SEQ ID NO: 69888 - DNA, 18 bp, Artificial Sequence
  Synthetic DNA
aaagacatctcacaatag

SEQ ID NO: 69889 - DNA, 18 bp, Artificial Sequence
  Synthetic DNA
aaataatactcgatatag

SEQ ID NO: 69890 - DNA, 18 bp, Artificial Sequence
  Synthetic DNA
aaatacaactcacacttg

SEQ ID NO: 69891 - DNA, 18 bp, Artificial Sequence
  Synthetic DNA
aaatacaatcgtctttag

SEQ ID NO: 69892 - DNA, 18 bp, Artificial Sequence
  Synthetic DNA
aaatacatctcactaatg

SEQ ID NO: 69893 - DNA, 18 bp, Artificial Sequence
  Synthetic DNA
aaataccactgctaatag

SEQ ID NO: 69894 - DNA, 18 bp, Artificial Sequence
  Synthetic DNA
aaatacctctcaataatg

SEQ ID NO: 69895 - DNA, 18 bp, Artificial Sequence
  Synthetic DNA
aaatacgacccagaacag

SEQ ID NO: 69896 - DNA, 18 bp, Artificial Sequence
  Synthetic DNA
aaatacgactctttactg

SEQ ID NO: 69897 - DNA, 18 bp, Artificial Sequence
  Synthetic DNA
aaatacgactgtttattg

SEQ ID NO: 69898 - DNA, 18 bp, Artificial Sequence
  Synthetic DNA
aaatacgcccctcttgag

SEQ ID NO: 69899 - DNA, 18 bp, Artificial Sequence
  Synthetic DNA
aaatacgtaaaacttaag

SEQ ID NO: 69900 - DNA, 18 bp, Artificial Sequence
  Synthetic DNA
aaatacgtaactctatag

SEQ ID NO: 69901 - DNA, 18 bp, Artificial Sequence
  Synthetic DNA
aaatacgtctctcttaag

SEQ ID NO: 69902 - DNA, 18 bp, Artificial Sequence
  Synthetic DNA
aaatacgtttctcttaag

SEQ ID NO: 69903 - DNA, 18 bp, Artificial Sequence
  Synthetic DNA
aaatactacacattttag

SEQ ID NO: 69904 - DNA, 18 bp, Artificial Sequence
  Synthetic DNA
aaatactattcactcaag

SEQ ID NO: 69905 - DNA, 18 bp, Artificial Sequence
  Synthetic DNA
aaatagaactaacgtagg

SEQ ID NO: 69906 - DNA, 18 bp, Artificial Sequence
  Synthetic DNA
aaatatgacaccatgtag

SEQ ID NO: 69907 - DNA, 18 bp, Artificial Sequence
  Synthetic DNA
aaatctgattccctttag

SEQ ID NO: 69908 - DNA, 18 bp, Artificial Sequence
  Synthetic DNA
aaatgagtcttactttag

SEQ ID NO: 69909 - DNA, 18 bp, Artificial Sequence
  Synthetic DNA
aaatgcaaccctctatcg

SEQ ID NO: 69910 - DNA, 18 bp, Artificial Sequence
  Synthetic DNA
aaatgcaccacactacag

SEQ ID NO: 69911 - DNA, 18 bp, Artificial Sequence
  Synthetic DNA
aaatgccactcactagtg

SEQ ID NO: 69912 - DNA, 18 bp, Artificial Sequence
  Synthetic DNA
aaatgcgacatcctcaag

SEQ ID NO: 69913 - DNA, 18 bp, Artificial Sequence
  Synthetic DNA
aaatgcgattcaggactg

SEQ ID NO: 69914 - DNA, 18 bp, Artificial Sequence
  Synthetic DNA
aaatgcgtcacgctattg

SEQ ID NO: 69915 - DNA, 18 bp, Artificial Sequence
  Synthetic DNA
aaatgtgacacactttag

SEQ ID NO: 69916 - DNA, 18 bp, Artificial Sequence
  Synthetic DNA
aaattcgacacactactg

SEQ ID NO: 69917 - DNA, 18 bp, Artificial Sequence
  Synthetic DNA
aaattcgaccctttttag

SEQ ID NO: 69918 - DNA, 18 bp, Artificial Sequence
  Synthetic DNA
aaattcgtctcacaattg

SEQ ID NO: 69919 - DNA, 18 bp, Artificial Sequence
  Synthetic DNA
aaattcgtcttacaattg

SEQ ID NO: 69920 - DNA, 18 bp, Artificial Sequence
  Synthetic DNA
aaattctaatcactagtg

SEQ ID NO: 69921 - DNA, 18 bp, Artificial Sequence
  Synthetic DNA
aaattctactctctaaag

SEQ ID NO: 69922 - DNA, 18 bp, Artificial Sequence
  Synthetic DNA
aaatttgcctctctgaag

SEQ ID NO: 69923 - DNA, 18 bp, Artificial Sequence
  Synthetic DNA
aacaacgaactcgtacag

SEQ ID NO: 69924 - DNA, 18 bp, Artificial Sequence
  Synthetic DNA
aactaagacttacaatag

SEQ ID NO: 69925 - DNA, 18 bp, Artificial Sequence
  Synthetic DNA
aactaccacccactttag

SEQ ID NO: 69926 - DNA, 18 bp, Artificial Sequence
  Synthetic DNA
aagaacgactaactattg

SEQ ID NO: 69927 - DNA, 18 bp, Artificial Sequence
  Synthetic DNA
aagtaagactcacattcg

SEQ ID NO: 69928 - DNA, 18 bp, Artificial Sequence
  Synthetic DNA
aataacgactcacaattg

SEQ ID NO: 69929 - DNA, 18 bp, Artificial Sequence
  Synthetic DNA
aataacgactcattctag

SEQ ID NO: 69930 - DNA, 18 bp, Artificial Sequence
  Synthetic DNA
aatcacaactcagtattg

SEQ ID NO: 69931 - DNA, 18 bp, Artificial Sequence
  Synthetic DNA
aatcacgtatacataaag

SEQ ID NO: 69932 - DNA, 18 bp, Artificial Sequence
  Synthetic DNA
aatcccgactaactatag

SEQ ID NO: 69933 - DNA, 18 bp, Artificial Sequence
  Synthetic DNA
aattacaattctctatag

SEQ ID NO: 69934 - DNA, 18 bp, Artificial Sequence
  Synthetic DNA
aattaccaaacactatgg

SEQ ID NO: 69935 - DNA, 18 bp, Artificial Sequence
  Synthetic DNA
aattacctctcacaatag

SEQ ID NO: 69936 - DNA, 18 bp, Artificial Sequence
  Synthetic DNA
aattacgacacaccaaag

SEQ ID NO: 69937 - DNA, 18 bp, Artificial Sequence
  Synthetic DNA
aattacgattagcgttag

SEQ ID NO: 69938 - DNA, 18 bp, Artificial Sequence
  Synthetic DNA
aattactacccacaatag

SEQ ID NO: 69939 - DNA, 18 bp, Artificial Sequence
  Synthetic DNA
aattactacttactctag

SEQ ID NO: 69940 - DNA, 18 bp, Artificial Sequence
  Synthetic DNA
aattacttatcagtaatg

SEQ ID NO: 69941 - DNA, 18 bp, Artificial Sequence
  Synthetic DNA
aattatcactcactgtag

SEQ ID NO: 69942 - DNA, 18 bp, Artificial Sequence
  Synthetic DNA
aattatctcacactaaag

SEQ ID NO: 69943 - DNA, 18 bp, Artificial Sequence
  Synthetic DNA
aattccagctcattatag

SEQ ID NO: 69944 - DNA, 18 bp, Artificial Sequence
  Synthetic DNA
aatttcggcacactccag

SEQ ID NO: 69945 - DNA, 18 bp, Artificial Sequence
  Synthetic DNA
acataagtttcaccacag

SEQ ID NO: 69946 - DNA, 18 bp, Artificial Sequence
  Synthetic DNA
acatacaacttactgtag

SEQ ID NO: 69947 - DNA, 18 bp, Artificial Sequence
  Synthetic DNA
acatacttctctctatag

SEQ ID NO: 69948 - DNA, 18 bp, Artificial Sequence
  Synthetic DNA
acatccgactcactaacg

SEQ ID NO: 69949 - DNA, 18 bp, Artificial Sequence
  Synthetic DNA
actcccgacacactatag

SEQ ID NO: 69950 - DNA, 18 bp, Artificial Sequence
  Synthetic DNA
acttacgactccctttcg

SEQ ID NO: 69951 - DNA, 18 bp, Artificial Sequence
  Synthetic DNA
agatacaactcagtcaag

SEQ ID NO: 69952 - DNA, 18 bp, Artificial Sequence
  Synthetic DNA
agatacgaatctcataag

SEQ ID NO: 69953 - DNA, 18 bp, Artificial Sequence
  Synthetic DNA
agatacgcctcactcatg

SEQ ID NO: 69954 - DNA, 18 bp, Artificial Sequence
  Synthetic DNA
agatccgtcaccctattg

SEQ ID NO: 69955 - DNA, 18 bp, Artificial Sequence
  Synthetic DNA
agatgcatttctctttag

SEQ ID NO: 69956 - DNA, 18 bp, Artificial Sequence
  Synthetic DNA
aggtacgacttactttag

SEQ ID NO: 69957 - DNA, 18 bp, Artificial Sequence
  Synthetic DNA
agttgccactcactaaag

SEQ ID NO: 69958 - DNA, 18 bp, Artificial Sequence
  Synthetic DNA
ataaacaactcattaaag

SEQ ID NO: 69959 - DNA, 18 bp, Artificial Sequence
  Synthetic DNA
ataaacacctctctatag

SEQ ID NO: 69960 - DNA, 18 bp, Artificial Sequence
  Synthetic DNA
ataaacgattcaccatag

SEQ ID NO: 69961 - DNA, 18 bp, Artificial Sequence
  Synthetic DNA
ataaaggacttaatttag

SEQ ID NO: 69962 - DNA, 18 bp, Artificial Sequence
  Synthetic DNA
ataatcgactctctattg

SEQ ID NO: 69963 - DNA, 18 bp, Artificial Sequence
  Synthetic DNA
atagacttctcactatag

SEQ ID NO: 69964 - DNA, 18 bp, Artificial Sequence
  Synthetic DNA
atataagatacactctag

SEQ ID NO: 69965 - DNA, 18 bp, Artificial Sequence
  Synthetic DNA
atataagccccattattg

SEQ ID NO: 69966 - DNA, 18 bp, Artificial Sequence
  Synthetic DNA
atatacaactcatgatag

SEQ ID NO: 69967 - DNA, 18 bp, Artificial Sequence
  Synthetic DNA
atatacatcacacaatag

SEQ ID NO: 69968 - DNA, 18 bp, Artificial Sequence
  Synthetic DNA
atatacgaaacattattg

SEQ ID NO: 69969 - DNA, 18 bp, Artificial Sequence
  Synthetic DNA
atatacgacttacttttg

SEQ ID NO: 69970 - DNA, 18 bp, Artificial Sequence
  Synthetic DNA
atatacgcttcagtatag

SEQ ID NO: 69971 - DNA, 18 bp, Artificial Sequence
  Synthetic DNA
atatacgtaccaccatag

SEQ ID NO: 69972 - DNA, 18 bp, Artificial Sequence
  Synthetic DNA
atatacgtttcccattag

SEQ ID NO: 69973 - DNA, 18 bp, Artificial Sequence
  Synthetic DNA
atatacgtttgtttatgg

SEQ ID NO: 69974 - DNA, 18 bp, Artificial Sequence
  Synthetic DNA
atatacgttttatcatag

SEQ ID NO: 69975 - DNA, 18 bp, Artificial Sequence
  Synthetic DNA
atatactaaacacattag

SEQ ID NO: 69976 - DNA, 18 bp, Artificial Sequence
  Synthetic DNA
atatactacttattacag

SEQ ID NO: 69977 - DNA, 18 bp, Artificial Sequence
  Synthetic DNA
atatactattcactttag

SEQ ID NO: 69978 - DNA, 18 bp, Artificial Sequence
  Synthetic DNA
atatagatttcactatag

SEQ ID NO: 69979 - DNA, 18 bp, Artificial Sequence
  Synthetic DNA
atatagtaatcactctag

SEQ ID NO: 69980 - DNA, 18 bp, Artificial Sequence
  Synthetic DNA
atatatgtctcactattg

SEQ ID NO: 69981 - DNA, 18 bp, Artificial Sequence
  Synthetic DNA
atatcccattcactatag

SEQ ID NO: 69982 - DNA, 18 bp, Artificial Sequence
  Synthetic DNA
atatcctaatcactattg

SEQ ID NO: 69983 - DNA, 18 bp, Artificial Sequence
  Synthetic DNA
atatgcgattcccttgag

SEQ ID NO: 69984 - DNA, 18 bp, Artificial Sequence
  Synthetic DNA
atattcgcctctccattg

SEQ ID NO: 69985 - DNA, 18 bp, Artificial Sequence
  Synthetic DNA
atgtacgactcactagtg

SEQ ID NO: 69986 - DNA, 18 bp, Artificial Sequence
  Synthetic DNA
atgtacgactctctgtag

SEQ ID NO: 69987 - DNA, 18 bp, Artificial Sequence
  Synthetic DNA
atgtacgagtccctattg

SEQ ID NO: 69988 - DNA, 18 bp, Artificial Sequence
  Synthetic DNA
atgtactactcactaaag

SEQ ID NO: 69989 - DNA, 18 bp, Artificial Sequence
  Synthetic DNA
attaacctttctctattg

SEQ ID NO: 69990 - DNA, 18 bp, Artificial Sequence
  Synthetic DNA
attaccaactcactatag

SEQ ID NO: 69991 - DNA, 18 bp, Artificial Sequence
  Synthetic DNA
attcactatactgtatag

SEQ ID NO: 69992 - DNA, 18 bp, Artificial Sequence
  Synthetic DNA
atttaattctcactttcg

SEQ ID NO: 69993 - DNA, 18 bp, Artificial Sequence
  Synthetic DNA
atttaccagtcactatag

SEQ ID NO: 69994 - DNA, 18 bp, Artificial Sequence
  Synthetic DNA
atttactactcaatatag

SEQ ID NO: 69995 - DNA, 18 bp, Artificial Sequence
  Synthetic DNA
atttacttctcaatgtag

SEQ ID NO: 69996 - DNA, 18 bp, Artificial Sequence
  Synthetic DNA
atttcggatttacaacag

SEQ ID NO: 69997 - DNA, 18 bp, Artificial Sequence
  Synthetic DNA
caaaacgactatctattg

SEQ ID NO: 69998 - DNA, 18 bp, Artificial Sequence
  Synthetic DNA
caaaacgtctctaaatag

SEQ ID NO: 69999 - DNA, 18 bp, Artificial Sequence
  Synthetic DNA
caaaactactcgacattg

SEQ ID NO: 70000 - DNA, 18 bp, Artificial Sequence
  Synthetic DNA
caaaatgactcgatatag

SEQ ID NO: 70001 - DNA, 18 bp, Artificial Sequence
  Synthetic DNA
caaaatgtatcactatag

SEQ ID NO: 70002 - DNA, 18 bp, Artificial Sequence
  Synthetic DNA
caaatagactcaccttag

SEQ ID NO: 70003 - DNA, 18 bp, Artificial Sequence
  Synthetic DNA
caacattactcacaattg

SEQ ID NO: 70004 - DNA, 18 bp, Artificial Sequence
  Synthetic DNA
caataagactcactgctg

SEQ ID NO: 70005 - DNA, 18 bp, Artificial Sequence
  Synthetic DNA
caataagtctctctattg

SEQ ID NO: 70006 - DNA, 18 bp, Artificial Sequence
  Synthetic DNA
caataatactcacaatcg

SEQ ID NO: 70007 - DNA, 18 bp, Artificial Sequence
  Synthetic DNA
caatacaatccattatag

SEQ ID NO: 70008 - DNA, 18 bp, Artificial Sequence
  Synthetic DNA
caatacatataactatag

SEQ ID NO: 70009 - DNA, 18 bp, Artificial Sequence
  Synthetic DNA
caataccacacaccttag

SEQ ID NO: 70010 - DNA, 18 bp, Artificial Sequence
  Synthetic DNA
caatacgactcacatatg

SEQ ID NO: 70011 - DNA, 18 bp, Artificial Sequence
  Synthetic DNA
caatacgcttcgcatttg

SEQ ID NO: 70012 - DNA, 18 bp, Artificial Sequence
  Synthetic DNA
caatactattctcaattg

SEQ ID NO: 70013 - DNA, 18 bp, Artificial Sequence
  Synthetic DNA
caatactcatcactaaag

SEQ ID NO: 70014 - DNA, 18 bp, Artificial Sequence
  Synthetic DNA
caatactgctcacaatcg

SEQ ID NO: 70015 - DNA, 18 bp, Artificial Sequence
  Synthetic DNA
caatatgacccgccatag

SEQ ID NO: 70016 - DNA, 18 bp, Artificial Sequence
  Synthetic DNA
caatccgagagtatatag

SEQ ID NO: 70017 - DNA, 18 bp, Artificial Sequence
  Synthetic DNA
caatgggactctgtatag

SEQ ID NO: 70018 - DNA, 18 bp, Artificial Sequence
  Synthetic DNA
caattcgactaggtatgg

SEQ ID NO: 70019 - DNA, 18 bp, Artificial Sequence
  Synthetic DNA
caattcgtctctctattg

SEQ ID NO: 70020 - DNA, 18 bp, Artificial Sequence
  Synthetic DNA
caattggcctcgctttag

SEQ ID NO: 70021 - DNA, 18 bp, Artificial Sequence
  Synthetic DNA
caatttgtctcactaaag

SEQ ID NO: 70022 - DNA, 18 bp, Artificial Sequence
  Synthetic DNA
cacatcgactcactaaag

SEQ ID NO: 70023 - DNA, 18 bp, Artificial Sequence
  Synthetic DNA
cactacgtctcacttaag

SEQ ID NO: 70024 - DNA, 18 bp, Artificial Sequence
  Synthetic DNA
cactaggactcattattg

SEQ ID NO: 70025 - DNA, 18 bp, Artificial Sequence
  Synthetic DNA
cagtcagactcaggatag

SEQ ID NO: 70026 - DNA, 18 bp, Artificial Sequence
  Synthetic DNA
cattacgacttactcaag

SEQ ID NO: 70027 - DNA, 18 bp, Artificial Sequence
  Synthetic DNA
cattacgtcacaccatag

SEQ ID NO: 70028 - DNA, 18 bp, Artificial Sequence
  Synthetic DNA
cattactaattaatattg

SEQ ID NO: 70029 - DNA, 18 bp, Artificial Sequence
  Synthetic DNA
cgataggacacattgaag

SEQ ID NO: 70030 - DNA, 18 bp, Artificial Sequence
  Synthetic DNA
cgatatgaatctcaatag

SEQ ID NO: 70031 - DNA, 18 bp, Artificial Sequence
  Synthetic DNA
cgattcgactcatttttg

SEQ ID NO: 70032 - DNA, 18 bp, Artificial Sequence
  Synthetic DNA
cgatttgacgcactattg

SEQ ID NO: 70033 - DNA, 18 bp, Artificial Sequence
  Synthetic DNA
ctaaacgactcagcatag

SEQ ID NO: 70034 - DNA, 18 bp, Artificial Sequence
  Synthetic DNA
ctaaatttcactattccg

SEQ ID NO: 70035 - DNA, 18 bp, Artificial Sequence
  Synthetic DNA
ctagaagacttagtatag

SEQ ID NO: 70036 - DNA, 18 bp, Artificial Sequence
  Synthetic DNA
ctatacgtctcacattag

SEQ ID NO: 70037 - DNA, 18 bp, Artificial Sequence
  Synthetic DNA
ctatacgtctccatatag

SEQ ID NO: 70038 - DNA, 18 bp, Artificial Sequence
  Synthetic DNA
ctatactattctcaatag

SEQ ID NO: 70039 - DNA, 18 bp, Artificial Sequence
  Synthetic DNA
ctataggactcagtcaag

SEQ ID NO: 70040 - DNA, 18 bp, Artificial Sequence
  Synthetic DNA
ctatgcatcttcctatag

SEQ ID NO: 70041 - DNA, 18 bp, Artificial Sequence
  Synthetic DNA
ctatgcggctctctatag

SEQ ID NO: 70042 - DNA, 18 bp, Artificial Sequence
  Synthetic DNA
ctcttatacacactatag

SEQ ID NO: 70043 - DNA, 18 bp, Artificial Sequence
  Synthetic DNA
ctttacgacacacaatag

SEQ ID NO: 70044 - DNA, 18 bp, Artificial Sequence
  Synthetic DNA
gaacacgactcccattag

SEQ ID NO: 70045 - DNA, 18 bp, Artificial Sequence
  Synthetic DNA
gaatacaacacgcaaaag

SEQ ID NO: 70046 - DNA, 18 bp, Artificial Sequence
  Synthetic DNA
gaatacagctcattctag

SEQ ID NO: 70047 - DNA, 18 bp, Artificial Sequence
  Synthetic DNA
gaatacgtctgattattg

SEQ ID NO: 70048 - DNA, 18 bp, Artificial Sequence
  Synthetic DNA
gaatagtactcaatgtag

SEQ ID NO: 70049 - DNA, 18 bp, Artificial Sequence
  Synthetic DNA
gaattagtcagactatag

SEQ ID NO: 70050 - DNA, 18 bp, Artificial Sequence
  Synthetic DNA
gaattcgacacacaatgg

SEQ ID NO: 70051 - DNA, 18 bp, Artificial Sequence
  Synthetic DNA
gaatttgtctcactcaag

SEQ ID NO: 70052 - DNA, 18 bp, Artificial Sequence
  Synthetic DNA
gagcacgaatcactaaaa

SEQ ID NO: 70053 - DNA, 18 bp, Artificial Sequence
  Synthetic DNA
gataacgcctcactgtag

SEQ ID NO: 70054 - DNA, 18 bp, Artificial Sequence
  Synthetic DNA
gatcacgactcgctttag

SEQ ID NO: 70055 - DNA, 18 bp, Artificial Sequence
  Synthetic DNA
gattaggacccactattg

SEQ ID NO: 70056 - DNA, 18 bp, Artificial Sequence
  Synthetic DNA
gcatactactcaacatag

SEQ ID NO: 70057 - DNA, 18 bp, Artificial Sequence
  Synthetic DNA
gtatacatccctgtgtag

SEQ ID NO: 70058 - DNA, 18 bp, Artificial Sequence
  Synthetic DNA
gtatacgacacattcaag

SEQ ID NO: 70059 - DNA, 18 bp, Artificial Sequence
  Synthetic DNA
gtatacgattcacaattg

SEQ ID NO: 70060 - DNA, 18 bp, Artificial Sequence
  Synthetic DNA
gtatacttataacaatag

SEQ ID NO: 70061 - DNA, 18 bp, Artificial Sequence
  Synthetic DNA
gtattcgattcaatatag

SEQ ID NO: 70062 - DNA, 18 bp, Artificial Sequence
  Synthetic DNA
gtttacgacccactttag

SEQ ID NO: 70063 - DNA, 18 bp, Artificial Sequence
  Synthetic DNA
taaaaactcttactaaag

SEQ ID NO: 70064 - DNA, 18 bp, Artificial Sequence
  Synthetic DNA
taaaaagacacattacag

SEQ ID NO: 70065 - DNA, 18 bp, Artificial Sequence
  Synthetic DNA
taaaaagtcttacttcag

SEQ ID NO: 70066 - DNA, 18 bp, Artificial Sequence
  Synthetic DNA
taaaacaactgcccatag

SEQ ID NO: 70067 - DNA, 18 bp, Artificial Sequence
  Synthetic DNA
taaaacatcactctaaag

SEQ ID NO: 70068 - DNA, 18 bp, Artificial Sequence
  Synthetic DNA
taaaacctatcactttag

SEQ ID NO: 70069 - DNA, 18 bp, Artificial Sequence
  Synthetic DNA
taaaacgaatcgcaaaag

SEQ ID NO: 70070 - DNA, 18 bp, Artificial Sequence
  Synthetic DNA
taaaacgaatcttgttag

SEQ ID NO: 70071 - DNA, 18 bp, Artificial Sequence
  Synthetic DNA
taaaacgacttgcactag

SEQ ID NO: 70072 - DNA, 18 bp, Artificial Sequence
  Synthetic DNA
taaaacgatacacattgg

SEQ ID NO: 70073 - DNA, 18 bp, Artificial Sequence
  Synthetic DNA
taaaacgattatctaaag

SEQ ID NO: 70074 - DNA, 18 bp, Artificial Sequence
  Synthetic DNA
taaaacggatctcgaaag

SEQ ID NO: 70075 - DNA, 18 bp, Artificial Sequence
  Synthetic DNA
taaaacgtcacaaagtcg

SEQ ID NO: 70076 - DNA, 18 bp, Artificial Sequence
  Synthetic DNA
taaaacgtctgatatttg

SEQ ID NO: 70077 - DNA, 18 bp, Artificial Sequence
  Synthetic DNA
taaaacgtcttacagtag

SEQ ID NO: 70078 - DNA, 18 bp, Artificial Sequence
  Synthetic DNA
taaaacgtttcataatag

SEQ ID NO: 70079 - DNA, 18 bp, Artificial Sequence
  Synthetic DNA
taaaacgttttactgtag

SEQ ID NO: 70080 - DNA, 18 bp, Artificial Sequence
  Synthetic DNA
taaaactaaactttattg

SEQ ID NO: 70081 - DNA, 18 bp, Artificial Sequence
  Synthetic DNA
taaaactattcactaccg

SEQ ID NO: 70082 - DNA, 18 bp, Artificial Sequence
  Synthetic DNA
taaaatgactaacttaag

SEQ ID NO: 70083 - DNA, 18 bp, Artificial Sequence
  Synthetic DNA
taaaatgcctcactactg

SEQ ID NO: 70084 - DNA, 18 bp, Artificial Sequence
  Synthetic DNA
taaaatgtatcactgaag

SEQ ID NO: 70085 - DNA, 18 bp, Artificial Sequence
  Synthetic DNA
taaaattactgacaatag

SEQ ID NO: 70086 - DNA, 18 bp, Artificial Sequence
  Synthetic DNA
taaacacagacactttag

SEQ ID NO: 70087 - DNA, 18 bp, Artificial Sequence
  Synthetic DNA
taaaccaacttactacag

SEQ ID NO: 70088 - DNA, 18 bp, Artificial Sequence
  Synthetic DNA
taaaccgactatgtgtcg

SEQ ID NO: 70089 - DNA, 18 bp, Artificial Sequence
  Synthetic DNA
taaaccttctaagtatag

SEQ ID NO: 70090 - DNA, 18 bp, Artificial Sequence
  Synthetic DNA
taaagatacacaatagag

SEQ ID NO: 70091 - DNA, 18 bp, Artificial Sequence
  Synthetic DNA
taaagcgactcaaattag

SEQ ID NO: 70092 - DNA, 18 bp, Artificial Sequence
  Synthetic DNA
taaagtcactcaatatag

SEQ ID NO: 70093 - DNA, 18 bp, Artificial Sequence
  Synthetic DNA
taaataatcccactaaag

SEQ ID NO: 70094 - DNA, 18 bp, Artificial Sequence
  Synthetic DNA
taaatcgacactttatag

SEQ ID NO: 70095 - DNA, 18 bp, Artificial Sequence
  Synthetic DNA
taaatcgactctttttag

SEQ ID NO: 70096 - DNA, 18 bp, Artificial Sequence
  Synthetic DNA
taaatcgacttacttcag

SEQ ID NO: 70097 - DNA, 18 bp, Artificial Sequence
  Synthetic DNA
taacaatacttactattg

SEQ ID NO: 70098 - DNA, 18 bp, Artificial Sequence
  Synthetic DNA
taacacaactgcctttag

SEQ ID NO: 70099 - DNA, 18 bp, Artificial Sequence
  Synthetic DNA
taacacaagtaattatgg

SEQ ID NO: 70100 - DNA, 18 bp, Artificial Sequence
  Synthetic DNA
taacacgacaaacttcag

SEQ ID NO: 70101 - DNA, 18 bp, Artificial Sequence
  Synthetic DNA
taacacgagtccataatg

SEQ ID NO: 70102 - DNA, 18 bp, Artificial Sequence
  Synthetic DNA
taacactaataacagtag

SEQ ID NO: 70103 - DNA, 18 bp, Artificial Sequence
  Synthetic DNA
taacactactatttatag

SEQ ID NO: 70104 - DNA, 18 bp, Artificial Sequence
  Synthetic DNA
taacaggactcacagttg

SEQ ID NO: 70105 - DNA, 18 bp, Artificial Sequence
  Synthetic DNA
taacatcaaacacaatag

SEQ ID NO: 70106 - DNA, 18 bp, Artificial Sequence
  Synthetic DNA
taacatctctcacaatag

SEQ ID NO: 70107 - DNA, 18 bp, Artificial Sequence
  Synthetic DNA
taacatgtcccactttag

SEQ ID NO: 70108 - DNA, 18 bp, Artificial Sequence
  Synthetic DNA
taacccgtataactttag

SEQ ID NO: 70109 - DNA, 18 bp, Artificial Sequence
  Synthetic DNA
taactcaactcatgctag

SEQ ID NO: 70110 - DNA, 18 bp, Artificial Sequence
  Synthetic DNA
taactcgatacattaaag

SEQ ID NO: 70111 - DNA, 18 bp, Artificial Sequence
  Synthetic DNA
taactcgtctcactcttg

SEQ ID NO: 70112 - DNA, 18 bp, Artificial Sequence
  Synthetic DNA
taactcgtctcactttcg

SEQ ID NO: 70113 - DNA, 18 bp, Artificial Sequence
  Synthetic DNA
taagacgacgtaccaatg

SEQ ID NO: 70114 - DNA, 18 bp, Artificial Sequence
  Synthetic DNA
taagagtacagaatgaag

SEQ ID NO: 70115 - DNA, 18 bp, Artificial Sequence
  Synthetic DNA
taagtcgaatcactaatg

SEQ ID NO: 70116 - DNA, 18 bp, Artificial Sequence
  Synthetic DNA
taagtcgtaagtcaattg

SEQ ID NO: 70117 - DNA, 18 bp, Artificial Sequence
  Synthetic DNA
taataaaactatctcaag

SEQ ID NO: 70118 - DNA, 18 bp, Artificial Sequence
  Synthetic DNA
taataaatcccactaaag

SEQ ID NO: 70119 - DNA, 18 bp, Artificial Sequence
  Synthetic DNA
taataagaataccaaaag

SEQ ID NO: 70120 - DNA, 18 bp, Artificial Sequence
  Synthetic DNA
taataagacttacttatg

SEQ ID NO: 70121 - DNA, 18 bp, Artificial Sequence
  Synthetic DNA
taataaggcttacaaacg

SEQ ID NO: 70122 - DNA, 18 bp, Artificial Sequence
  Synthetic DNA
taataagtcacacatttg

SEQ ID NO: 70123 - DNA, 18 bp, Artificial Sequence
  Synthetic DNA
taataagtcatactttag

SEQ ID NO: 70124 - DNA, 18 bp, Artificial Sequence
  Synthetic DNA
taataatacttattgtag

SEQ ID NO: 70125 - DNA, 18 bp, Artificial Sequence
  Synthetic DNA
taatacaactttcattag

SEQ ID NO: 70126 - DNA, 18 bp, Artificial Sequence
  Synthetic DNA
taatacacatcagtgtag

SEQ ID NO: 70127 - DNA, 18 bp, Artificial Sequence
  Synthetic DNA
taatacatcatacaatag

SEQ ID NO: 70128 - DNA, 18 bp, Artificial Sequence
  Synthetic DNA
taatacatgtcgctttag

SEQ ID NO: 70129 - DNA, 18 bp, Artificial Sequence
  Synthetic DNA
taatacatttcacattcg

SEQ ID NO: 70130 - DNA, 18 bp, Artificial Sequence
  Synthetic DNA
taatacatttcaccccag

SEQ ID NO: 70131 - DNA, 18 bp, Artificial Sequence
  Synthetic DNA
taatacatttcactaacg

SEQ ID NO: 70132 - DNA, 18 bp, Artificial Sequence
  Synthetic DNA
taataccaatatatatag

SEQ ID NO: 70133 - DNA, 18 bp, Artificial Sequence
  Synthetic DNA
taataccactctacattg

SEQ ID NO: 70134 - DNA, 18 bp, Artificial Sequence
  Synthetic DNA
taataccatacaccattg

SEQ ID NO: 70135 - DNA, 18 bp, Artificial Sequence
  Synthetic DNA
taataccatatacaattg

SEQ ID NO: 70136 - DNA, 18 bp, Artificial Sequence
  Synthetic DNA
taataccattccatttag

SEQ ID NO: 70137 - DNA, 18 bp, Artificial Sequence
  Synthetic DNA
taataccccatacaattg

SEQ ID NO: 70138 - DNA, 18 bp, Artificial Sequence
  Synthetic DNA
taataccgcccactctcg

SEQ ID NO: 70139 - DNA, 18 bp, Artificial Sequence
  Synthetic DNA
taatacctctcacggcag

SEQ ID NO: 70140 - DNA, 18 bp, Artificial Sequence
  Synthetic DNA
taatacctcttattaaag

SEQ ID NO: 70141 - DNA, 18 bp, Artificial Sequence
  Synthetic DNA
taatacgaattattaatg

SEQ ID NO: 70142 - DNA, 18 bp, Artificial Sequence
  Synthetic DNA
taatacgacacccaaacg

SEQ ID NO: 70143 - DNA, 18 bp, Artificial Sequence
  Synthetic DNA
taatacgacactttttgg

SEQ ID NO: 70144 - DNA, 18 bp, Artificial Sequence
  Synthetic DNA
taatacgacagccaattg

SEQ ID NO: 70145 - DNA, 18 bp, Artificial Sequence
  Synthetic DNA
taatacgacatgcattag

SEQ ID NO: 70146 - DNA, 18 bp, Artificial Sequence
  Synthetic DNA
taatacgaccttatctag

SEQ ID NO: 70147 - DNA, 18 bp, Artificial Sequence
  Synthetic DNA
taatacgactcatatatg

SEQ ID NO: 70148 - DNA, 18 bp, Artificial Sequence
  Synthetic DNA
taatacgactttcttacg

SEQ ID NO: 70149 - DNA, 18 bp, Artificial Sequence
  Synthetic DNA
taatacgacttttttttg

SEQ ID NO: 70150 - DNA, 18 bp, Artificial Sequence
  Synthetic DNA
taatacgagctacactag

SEQ ID NO: 70151 - DNA, 18 bp, Artificial Sequence
  Synthetic DNA
taatacgagcttcatctg

SEQ ID NO: 70152 - DNA, 18 bp, Artificial Sequence
  Synthetic DNA
taatacgcaagtctattg

SEQ ID NO: 70153 - DNA, 18 bp, Artificial Sequence
  Synthetic DNA
taatacgccgacatatag

SEQ ID NO: 70154 - DNA, 18 bp, Artificial Sequence
  Synthetic DNA
taatacgccttatataag

SEQ ID NO: 70155 - DNA, 18 bp, Artificial Sequence
  Synthetic DNA
taatacgcttgaatattg

SEQ ID NO: 70156 - DNA, 18 bp, Artificial Sequence
  Synthetic DNA
taatacggctatctaatg

SEQ ID NO: 70157 - DNA, 18 bp, Artificial Sequence
  Synthetic DNA
taatacggtgcattaatg

SEQ ID NO: 70158 - DNA, 18 bp, Artificial Sequence
  Synthetic DNA
taatacgtcccaacattg

SEQ ID NO: 70159 - DNA, 18 bp, Artificial Sequence
  Synthetic DNA
taatacgtcctatcatag

SEQ ID NO: 70160 - DNA, 18 bp, Artificial Sequence
  Synthetic DNA
taatacgtctgacctttg

SEQ ID NO: 70161 - DNA, 18 bp, Artificial Sequence
  Synthetic DNA
taatactaatgatttttg

SEQ ID NO: 70162 - DNA, 18 bp, Artificial Sequence
  Synthetic DNA
taatacttcaaaccatag

SEQ ID NO: 70163 - DNA, 18 bp, Artificial Sequence
  Synthetic DNA
taatactttacactaaag

SEQ ID NO: 70164 - DNA, 18 bp, Artificial Sequence
  Synthetic DNA
taatacttttcacttaag

SEQ ID NO: 70165 - DNA, 18 bp, Artificial Sequence
  Synthetic DNA
taataggaatctcaattg

SEQ ID NO: 70166 - DNA, 18 bp, Artificial Sequence
  Synthetic DNA
taataggcctgaaaattg

SEQ ID NO: 70167 - DNA, 18 bp, Artificial Sequence
  Synthetic DNA
taataggtctcacatatg

SEQ ID NO: 70168 - DNA, 18 bp, Artificial Sequence
  Synthetic DNA
taataggtctcccaattg

SEQ ID NO: 70169 - DNA, 18 bp, Artificial Sequence
  Synthetic DNA
taataggtcttaccttag

SEQ ID NO: 70170 - DNA, 18 bp, Artificial Sequence
  Synthetic DNA
taataggtttcataatag

SEQ ID NO: 70171 - DNA, 18 bp, Artificial Sequence
  Synthetic DNA
taatataactctcgaagg

SEQ ID NO: 70172 - DNA, 18 bp, Artificial Sequence
  Synthetic DNA
taatatgaaacgcgattg

SEQ ID NO: 70173 - DNA, 18 bp, Artificial Sequence
  Synthetic DNA
taatatgattttttatag

SEQ ID NO: 70174 - DNA, 18 bp, Artificial Sequence
  Synthetic DNA
taatattaagctctatag

SEQ ID NO: 70175 - DNA, 18 bp, Artificial Sequence
  Synthetic DNA
taatattactcagtgttg

SEQ ID NO: 70176 - DNA, 18 bp, Artificial Sequence
  Synthetic DNA
taatatttctctccatag

SEQ ID NO: 70177 - DNA, 18 bp, Artificial Sequence
  Synthetic DNA
taatatttcttacttaag

SEQ ID NO: 70178 - DNA, 18 bp, Artificial Sequence
  Synthetic DNA
taatcaatctgtctatag

SEQ ID NO: 70179 - DNA, 18 bp, Artificial Sequence
  Synthetic DNA
taatccatcttactctgg

SEQ ID NO: 70180 - DNA, 18 bp, Artificial Sequence
  Synthetic DNA
taatccgaaacgcaatag

SEQ ID NO: 70181 - DNA, 18 bp, Artificial Sequence
  Synthetic DNA
taatccgacaatcaatag

SEQ ID NO: 70182 - DNA, 18 bp, Artificial Sequence
  Synthetic DNA
taatccgacccccattag

SEQ ID NO: 70183 - DNA, 18 bp, Artificial Sequence
  Synthetic DNA
taatccgattatctattg

SEQ ID NO: 70184 - DNA, 18 bp, Artificial Sequence
  Synthetic DNA
taatcctacactcttttg

SEQ ID NO: 70185 - DNA, 18 bp, Artificial Sequence
  Synthetic DNA
taatcctccccactttag

SEQ ID NO: 70186 - DNA, 18 bp, Artificial Sequence
  Synthetic DNA
taatcggattcacttttg

SEQ ID NO: 70187 - DNA, 18 bp, Artificial Sequence
  Synthetic DNA
taatcggtctttctaaag

SEQ ID NO: 70188 - DNA, 18 bp, Artificial Sequence
  Synthetic DNA
taatgaggcacgccatag

SEQ ID NO: 70189 - DNA, 18 bp, Artificial Sequence
  Synthetic DNA
taatgcatgacattatag

SEQ ID NO: 70190 - DNA, 18 bp, Artificial Sequence
  Synthetic DNA
taatgcgacacagtactg

SEQ ID NO: 70191 - DNA, 18 bp, Artificial Sequence
  Synthetic DNA
taatgcgattcacataag

SEQ ID NO: 70192 - DNA, 18 bp, Artificial Sequence
  Synthetic DNA
taatgcgatttataactg

SEQ ID NO: 70193 - DNA, 18 bp, Artificial Sequence
  Synthetic DNA
taatgtaacttaataatg

SEQ ID NO: 70194 - DNA, 18 bp, Artificial Sequence
  Synthetic DNA
taattaaactctctttag

SEQ ID NO: 70195 - DNA, 18 bp, Artificial Sequence
  Synthetic DNA
taattagacccactaatg

SEQ ID NO: 70196 - DNA, 18 bp, Artificial Sequence
  Synthetic DNA
taattagactctctactg

SEQ ID NO: 70197 - DNA, 18 bp, Artificial Sequence
  Synthetic DNA
taattagtctcatttttg

SEQ ID NO: 70198 - DNA, 18 bp, Artificial Sequence
  Synthetic DNA
taattcacctcacgtgtg

SEQ ID NO: 70199 - DNA, 18 bp, Artificial Sequence
  Synthetic DNA
taattcagctttctattg

SEQ ID NO: 70200 - DNA, 18 bp, Artificial Sequence
  Synthetic DNA
taattcgaatctcttaag

SEQ ID NO: 70201 - DNA, 18 bp, Artificial Sequence
  Synthetic DNA
taattcgacaatcaatag

SEQ ID NO: 70202 - DNA, 18 bp, Artificial Sequence
  Synthetic DNA
taattcgacaatccatag

SEQ ID NO: 70203 - DNA, 18 bp, Artificial Sequence
  Synthetic DNA
taattcgacactatattg

SEQ ID NO: 70204 - DNA, 18 bp, Artificial Sequence
  Synthetic DNA
taattcgacatacgaaag

SEQ ID NO: 70205 - DNA, 18 bp, Artificial Sequence
  Synthetic DNA
taattcgacatactaatg

SEQ ID NO: 70206 - DNA, 18 bp, Artificial Sequence
  Synthetic DNA
taattcgactcgctcatg

SEQ ID NO: 70207 - DNA, 18 bp, Artificial Sequence
  Synthetic DNA
taattcgactcttaaaag

SEQ ID NO: 70208 - DNA, 18 bp, Artificial Sequence
  Synthetic DNA
taattcgaggcactaatg

SEQ ID NO: 70209 - DNA, 18 bp, Artificial Sequence
  Synthetic DNA
taattcgattctgtttcg

SEQ ID NO: 70210 - DNA, 18 bp, Artificial Sequence
  Synthetic DNA
taattcgcttctcaatag

SEQ ID NO: 70211 - DNA, 18 bp, Artificial Sequence
  Synthetic DNA
taattcgtatgactattg

SEQ ID NO: 70212 - DNA, 18 bp, Artificial Sequence
  Synthetic DNA
taattcgtcactccgaag

SEQ ID NO: 70213 - DNA, 18 bp, Artificial Sequence
  Synthetic DNA
taattcgtctcacattcg

SEQ ID NO: 70214 - DNA, 18 bp, Artificial Sequence
  Synthetic DNA
taattctaacaactatag

SEQ ID NO: 70215 - DNA, 18 bp, Artificial Sequence
  Synthetic DNA
taattctaatcactagcg

SEQ ID NO: 70216 - DNA, 18 bp, Artificial Sequence
  Synthetic DNA
taattctacataatatag

SEQ ID NO: 70217 - DNA, 18 bp, Artificial Sequence
  Synthetic DNA
taattctactaagtattg

SEQ ID NO: 70218 - DNA, 18 bp, Artificial Sequence
  Synthetic DNA
taattctactagctattg

SEQ ID NO: 70219 - DNA, 18 bp, Artificial Sequence
  Synthetic DNA
taattctactcgataaag

SEQ ID NO: 70220 - DNA, 18 bp, Artificial Sequence
  Synthetic DNA
taattctactttcattag

SEQ ID NO: 70221 - DNA, 18 bp, Artificial Sequence
  Synthetic DNA
taattctcctcacaatcg

SEQ ID NO: 70222 - DNA, 18 bp, Artificial Sequence
  Synthetic DNA
taattgtactttcttttg

SEQ ID NO: 70223 - DNA, 18 bp, Artificial Sequence
  Synthetic DNA
taatttctctcattattg

SEQ ID NO: 70224 - DNA, 18 bp, Artificial Sequence
  Synthetic DNA
taatttgaatctccatag

SEQ ID NO: 70225 - DNA, 18 bp, Artificial Sequence
  Synthetic DNA
taatttgactacctaaag

SEQ ID NO: 70226 - DNA, 18 bp, Artificial Sequence
  Synthetic DNA
taattttccttacaatag

SEQ ID NO: 70227 - DNA, 18 bp, Artificial Sequence
  Synthetic DNA
tacaacgtctaactcttg

SEQ ID NO: 70228 - DNA, 18 bp, Artificial Sequence
  Synthetic DNA
tactaagtttcagtttag

SEQ ID NO: 70229 - DNA, 18 bp, Artificial Sequence
  Synthetic DNA
tactaatattcactattg

SEQ ID NO: 70230 - DNA, 18 bp, Artificial Sequence
  Synthetic DNA
tactacccgtcaccatag

SEQ ID NO: 70231 - DNA, 18 bp, Artificial Sequence
  Synthetic DNA
tactacgaaactctacag

SEQ ID NO: 70232 - DNA, 18 bp, Artificial Sequence
  Synthetic DNA
tactacgacattatactg

SEQ ID NO: 70233 - DNA, 18 bp, Artificial Sequence
  Synthetic DNA
tactacgactcacatatg

SEQ ID NO: 70234 - DNA, 18 bp, Artificial Sequence
  Synthetic DNA
tactacgattcaataatg

SEQ ID NO: 70235 - DNA, 18 bp, Artificial Sequence
  Synthetic DNA
tactacggcgctttatag

SEQ ID NO: 70236 - DNA, 18 bp, Artificial Sequence
  Synthetic DNA
tactactactatctagag

SEQ ID NO: 70237 - DNA, 18 bp, Artificial Sequence
  Synthetic DNA
tactactactcgctcacg

SEQ ID NO: 70238 - DNA, 18 bp, Artificial Sequence
  Synthetic DNA
tactacttctcaatttag

SEQ ID NO: 70239 - DNA, 18 bp, Artificial Sequence
  Synthetic DNA
tactatgtctcaccaaag

SEQ ID NO: 70240 - DNA, 18 bp, Artificial Sequence
  Synthetic DNA
tactccgtttcgctacgg

SEQ ID NO: 70241 - DNA, 18 bp, Artificial Sequence
  Synthetic DNA
tacttcgaaacactttag

SEQ ID NO: 70242 - DNA, 18 bp, Artificial Sequence
  Synthetic DNA
tacttcgtttcccttaag

SEQ ID NO: 70243 - DNA, 18 bp, Artificial Sequence
  Synthetic DNA
tagaacgattctcttaag

SEQ ID NO: 70244 - DNA, 18 bp, Artificial Sequence
  Synthetic DNA
tagaacgtcgcactaatg

SEQ ID NO: 70245 - DNA, 18 bp, Artificial Sequence
  Synthetic DNA
tagaacgtctcaatatgg

SEQ ID NO: 70246 - DNA, 18 bp, Artificial Sequence
  Synthetic DNA
tagaacgtcttacagtag

SEQ ID NO: 70247 - DNA, 18 bp, Artificial Sequence
  Synthetic DNA
tagaactacatactctag

SEQ ID NO: 70248 - DNA, 18 bp, Artificial Sequence
  Synthetic DNA
tagaatgattctcttcag

SEQ ID NO: 70249 - DNA, 18 bp, Artificial Sequence
  Synthetic DNA
tagaatgcctctctatag

SEQ ID NO: 70250 - DNA, 18 bp, Artificial Sequence
  Synthetic DNA
tagactaactcactattg

SEQ ID NO: 70251 - DNA, 18 bp, Artificial Sequence
  Synthetic DNA
tagatctactggctaatg

SEQ ID NO: 70252 - DNA, 18 bp, Artificial Sequence
  Synthetic DNA
tagcactaaacacttcag

SEQ ID NO: 70253 - DNA, 18 bp, Artificial Sequence
  Synthetic DNA
tagcatgactcagtagtg

SEQ ID NO: 70254 - DNA, 18 bp, Artificial Sequence
  Synthetic DNA
tagtaagagcctcaattg

SEQ ID NO: 70255 - DNA, 18 bp, Artificial Sequence
  Synthetic DNA
tagtaagtctctttaaag

SEQ ID NO: 70256 - DNA, 18 bp, Artificial Sequence
  Synthetic DNA
tagtaatccacactatag

SEQ ID NO: 70257 - DNA, 18 bp, Artificial Sequence
  Synthetic DNA
tagtacatcctattagag

SEQ ID NO: 70258 - DNA, 18 bp, Artificial Sequence
  Synthetic DNA
tagtacgactaagaaacg

SEQ ID NO: 70259 - DNA, 18 bp, Artificial Sequence
  Synthetic DNA
tagtacgtttcacgattg

SEQ ID NO: 70260 - DNA, 18 bp, Artificial Sequence
  Synthetic DNA
tagtactacactctaaag

SEQ ID NO: 70261 - DNA, 18 bp, Artificial Sequence
  Synthetic DNA
tagtactacctacaatag

SEQ ID NO: 70262 - DNA, 18 bp, Artificial Sequence
  Synthetic DNA
tagtacttctctatatag

SEQ ID NO: 70263 - DNA, 18 bp, Artificial Sequence
  Synthetic DNA
tagtatgactagcaactg

SEQ ID NO: 70264 - DNA, 18 bp, Artificial Sequence
  Synthetic DNA
tagtccgaaacactattg

SEQ ID NO: 70265 - DNA, 18 bp, Artificial Sequence
  Synthetic DNA
tagtccgcctcaatacag

SEQ ID NO: 70266 - DNA, 18 bp, Artificial Sequence
  Synthetic DNA
tagtcctacactttattg

SEQ ID NO: 70267 - DNA, 18 bp, Artificial Sequence
  Synthetic DNA
tagtctaactcagatttg

SEQ ID NO: 70268 - DNA, 18 bp, Artificial Sequence
  Synthetic DNA
tagtgcgactcactcccg

SEQ ID NO: 70269 - DNA, 18 bp, Artificial Sequence
  Synthetic DNA
tagtgcgacttactactg

SEQ ID NO: 70270 - DNA, 18 bp, Artificial Sequence
  Synthetic DNA
tagttagactcacaattg

SEQ ID NO: 70271 - DNA, 18 bp, Artificial Sequence
  Synthetic DNA
tagttcaactcactaatg

SEQ ID NO: 70272 - DNA, 18 bp, Artificial Sequence
  Synthetic DNA
tagtttaatttactatag

SEQ ID NO: 70273 - DNA, 18 bp, Artificial Sequence
  Synthetic DNA
tataaagactcaataaag

SEQ ID NO: 70274 - DNA, 18 bp, Artificial Sequence
  Synthetic DNA
tataaagatttactatag

SEQ ID NO: 70275 - DNA, 18 bp, Artificial Sequence
  Synthetic DNA
tataacgactgactgttg

SEQ ID NO: 70276 - DNA, 18 bp, Artificial Sequence
  Synthetic DNA
tataacgacttactgaag

SEQ ID NO: 70277 - DNA, 18 bp, Artificial Sequence
  Synthetic DNA
tataacggcgcactacag

SEQ ID NO: 70278 - DNA, 18 bp, Artificial Sequence
  Synthetic DNA
tataacgtcacactattg

SEQ ID NO: 70279 - DNA, 18 bp, Artificial Sequence
  Synthetic DNA
tataacgtctagctttag

SEQ ID NO: 70280 - DNA, 18 bp, Artificial Sequence
  Synthetic DNA
tataacgtctcaatattg

SEQ ID NO: 70281 - DNA, 18 bp, Artificial Sequence
  Synthetic DNA
tataacgtctcattaaag

SEQ ID NO: 70282 - DNA, 18 bp, Artificial Sequence
  Synthetic DNA
tataatgactgtctatag

SEQ ID NO: 70283 - DNA, 18 bp, Artificial Sequence
  Synthetic DNA
tataccgactctatattg

SEQ ID NO: 70284 - DNA, 18 bp, Artificial Sequence
  Synthetic DNA
tataccgtgtcagtatag

SEQ ID NO: 70285 - DNA, 18 bp, Artificial Sequence
  Synthetic DNA
tatatcgacagacaatag

SEQ ID NO: 70286 - DNA, 18 bp, Artificial Sequence
  Synthetic DNA
tatatttgcacactatag

SEQ ID NO: 70287 - DNA, 18 bp, Artificial Sequence
  Synthetic DNA
tatcaagactctctttag

SEQ ID NO: 70288 - DNA, 18 bp, Artificial Sequence
  Synthetic DNA
tatcacgactctcaaaag

SEQ ID NO: 70289 - DNA, 18 bp, Artificial Sequence
  Synthetic DNA
tatcacgtctcttttaag

SEQ ID NO: 70290 - DNA, 18 bp, Artificial Sequence
  Synthetic DNA
tatcccgactcaatattg

SEQ ID NO: 70291 - DNA, 18 bp, Artificial Sequence
  Synthetic DNA
tatctagtctcactatag

SEQ ID NO: 70292 - DNA, 18 bp, Artificial Sequence
  Synthetic DNA
tatgacaacactctatag

SEQ ID NO: 70293 - DNA, 18 bp, Artificial Sequence
  Synthetic DNA
tatgtgtcgttactgtag

SEQ ID NO: 70294 - DNA, 18 bp, Artificial Sequence
  Synthetic DNA
tattaagactcattccag

SEQ ID NO: 70295 - DNA, 18 bp, Artificial Sequence
  Synthetic DNA
tattaagtcacactattg

SEQ ID NO: 70296 - DNA, 18 bp, Artificial Sequence
  Synthetic DNA
tattaagtctaactattg

SEQ ID NO: 70297 - DNA, 18 bp, Artificial Sequence
  Synthetic DNA
tattacaactcaaaaccg

SEQ ID NO: 70298 - DNA, 18 bp, Artificial Sequence
  Synthetic DNA
tattaccactcgttattg

SEQ ID NO: 70299 - DNA, 18 bp, Artificial Sequence
  Synthetic DNA
tattacgaacctttattg

SEQ ID NO: 70300 - DNA, 18 bp, Artificial Sequence
  Synthetic DNA
tattacgaatgacttaag

SEQ ID NO: 70301 - DNA, 18 bp, Artificial Sequence
  Synthetic DNA
tattacgactatcttttg

SEQ ID NO: 70302 - DNA, 18 bp, Artificial Sequence
  Synthetic DNA
tattacgactccccgaag

SEQ ID NO: 70303 - DNA, 18 bp, Artificial Sequence
  Synthetic DNA
tattacgagtatcttcag

SEQ ID NO: 70304 - DNA, 18 bp, Artificial Sequence
  Synthetic DNA
tattacgatacattttag

SEQ ID NO: 70305 - DNA, 18 bp, Artificial Sequence
  Synthetic DNA
tattacgattcaattaag

SEQ ID NO: 70306 - DNA, 18 bp, Artificial Sequence
  Synthetic DNA
tattacgcgtcatgaaag

SEQ ID NO: 70307 - DNA, 18 bp, Artificial Sequence
  Synthetic DNA
tattacggctaagtattg

SEQ ID NO: 70308 - DNA, 18 bp, Artificial Sequence
  Synthetic DNA
tattacgtatttcaaaag

SEQ ID NO: 70309 - DNA, 18 bp, Artificial Sequence
  Synthetic DNA
tattacgtctgattaagg

SEQ ID NO: 70310 - DNA, 18 bp, Artificial Sequence
  Synthetic DNA
tattacgtttcacttttg

SEQ ID NO: 70311 - DNA, 18 bp, Artificial Sequence
  Synthetic DNA
tattactacactcttaag

SEQ ID NO: 70312 - DNA, 18 bp, Artificial Sequence
  Synthetic DNA
tattactattccatatag

SEQ ID NO: 70313 - DNA, 18 bp, Artificial Sequence
  Synthetic DNA
tattacttcattatctag

SEQ ID NO: 70314 - DNA, 18 bp, Artificial Sequence
  Synthetic DNA
tattacttctagctatag

SEQ ID NO: 70315 - DNA, 18 bp, Artificial Sequence
  Synthetic DNA
tattagtaatcaatatag

SEQ ID NO: 70316 - DNA, 18 bp, Artificial Sequence
  Synthetic DNA
tattatagcacacttatg

SEQ ID NO: 70317 - DNA, 18 bp, Artificial Sequence
  Synthetic DNA
tattatgactgcctacag

SEQ ID NO: 70318 - DNA, 18 bp, Artificial Sequence
  Synthetic DNA
tattatgacttactaatg

SEQ ID NO: 70319 - DNA, 18 bp, Artificial Sequence
  Synthetic DNA
tattatgatattccacag

SEQ ID NO: 70320 - DNA, 18 bp, Artificial Sequence
  Synthetic DNA
tattatgtcaaactatag

SEQ ID NO: 70321 - DNA, 18 bp, Artificial Sequence
  Synthetic DNA
tattcagactcacgatcg

SEQ ID NO: 70322 - DNA, 18 bp, Artificial Sequence
  Synthetic DNA
tattccgactatttatag

SEQ ID NO: 70323 - DNA, 18 bp, Artificial Sequence
  Synthetic DNA
tattgcgacccaatattg

SEQ ID NO: 70324 - DNA, 18 bp, Artificial Sequence
  Synthetic DNA
tattgtgactctcaatag

SEQ ID NO: 70325 - DNA, 18 bp, Artificial Sequence
  Synthetic DNA
tatttcaacacattatag

SEQ ID NO: 70326 - DNA, 18 bp, Artificial Sequence
  Synthetic DNA
tatttcaactcacaatcg

SEQ ID NO: 70327 - DNA, 18 bp, Artificial Sequence
  Synthetic DNA
tatttcgaatcgctatcg

SEQ ID NO: 70328 - DNA, 18 bp, Artificial Sequence
  Synthetic DNA
tatttcgacaatctatag

SEQ ID NO: 70329 - DNA, 18 bp, Artificial Sequence
  Synthetic DNA
tatttcgacttacaaaag

SEQ ID NO: 70330 - DNA, 18 bp, Artificial Sequence
  Synthetic DNA
tatttcgattcaacaaag

SEQ ID NO: 70331 - DNA, 18 bp, Artificial Sequence
  Synthetic DNA
tatttcgattcacaaaag

SEQ ID NO: 70332 - DNA, 18 bp, Artificial Sequence
  Synthetic DNA
tatttcgtctctgtatag

SEQ ID NO: 70333 - DNA, 18 bp, Artificial Sequence
  Synthetic DNA
tatttctactcaccttag

SEQ ID NO: 70334 - DNA, 18 bp, Artificial Sequence
  Synthetic DNA
tatttctacttactgtag

SEQ ID NO: 70335 - DNA, 18 bp, Artificial Sequence
  Synthetic DNA
tatttgtacacactaatg

SEQ ID NO: 70336 - DNA, 18 bp, Artificial Sequence
  Synthetic DNA
tcaaaagacttcctatag

SEQ ID NO: 70337 - DNA, 18 bp, Artificial Sequence
  Synthetic DNA
tcaaacgaatcactagcg

SEQ ID NO: 70338 - DNA, 18 bp, Artificial Sequence
  Synthetic DNA
tcaatcgacacactaaag

SEQ ID NO: 70339 - DNA, 18 bp, Artificial Sequence
  Synthetic DNA
tcacacgacttatgagag

SEQ ID NO: 70340 - DNA, 18 bp, Artificial Sequence
  Synthetic DNA
tcacactagtaattatag

SEQ ID NO: 70341 - DNA, 18 bp, Artificial Sequence
  Synthetic DNA
tcataccactcaatgttg

SEQ ID NO: 70342 - DNA, 18 bp, Artificial Sequence
  Synthetic DNA
tcataccacttatcaacg

SEQ ID NO: 70343 - DNA, 18 bp, Artificial Sequence
  Synthetic DNA
tcatacctcacactaaag

SEQ ID NO: 70344 - DNA, 18 bp, Artificial Sequence
  Synthetic DNA
tcatacgatacttaattg

SEQ ID NO: 70345 - DNA, 18 bp, Artificial Sequence
  Synthetic DNA
tcatacgcctcaggatcg

SEQ ID NO: 70346 - DNA, 18 bp, Artificial Sequence
  Synthetic DNA
tcatacggccctccatag

SEQ ID NO: 70347 - DNA, 18 bp, Artificial Sequence
  Synthetic DNA
tcatacgtcacagaatag

SEQ ID NO: 70348 - DNA, 18 bp, Artificial Sequence
  Synthetic DNA
tcatacgtcacattggag

SEQ ID NO: 70349 - DNA, 18 bp, Artificial Sequence
  Synthetic DNA
tcatagcattcagtatag

SEQ ID NO: 70350 - DNA, 18 bp, Artificial Sequence
  Synthetic DNA
tcatagccttaactatag

SEQ ID NO: 70351 - DNA, 18 bp, Artificial Sequence
  Synthetic DNA
tcatagtacacgctatag

SEQ ID NO: 70352 - DNA, 18 bp, Artificial Sequence
  Synthetic DNA
tcatcagtatccctttag

SEQ ID NO: 70353 - DNA, 18 bp, Artificial Sequence
  Synthetic DNA
tcatctaactcacactag

SEQ ID NO: 70354 - DNA, 18 bp, Artificial Sequence
  Synthetic DNA
tcatgccactaatcatag

SEQ ID NO: 70355 - DNA, 18 bp, Artificial Sequence
  Synthetic DNA
tcatgcggtgctcaatgg

SEQ ID NO: 70356 - DNA, 18 bp, Artificial Sequence
  Synthetic DNA
tcatgcgtctcactttcg

SEQ ID NO: 70357 - DNA, 18 bp, Artificial Sequence
  Synthetic DNA
tcatgcgtctttctatag

SEQ ID NO: 70358 - DNA, 18 bp, Artificial Sequence
  Synthetic DNA
tcattagactcattattg

SEQ ID NO: 70359 - DNA, 18 bp, Artificial Sequence
  Synthetic DNA
tcattccactctcgattg

SEQ ID NO: 70360 - DNA, 18 bp, Artificial Sequence
  Synthetic DNA
tcattcgaattactctag

SEQ ID NO: 70361 - DNA, 18 bp, Artificial Sequence
  Synthetic DNA
tcattcgactcacttctg

SEQ ID NO: 70362 - DNA, 18 bp, Artificial Sequence
  Synthetic DNA
tcattctaataatcatag

SEQ ID NO: 70363 - DNA, 18 bp, Artificial Sequence
  Synthetic DNA
tccttcgaatctccattg

SEQ ID NO: 70364 - DNA, 18 bp, Artificial Sequence
  Synthetic DNA
tcgtattactctcaatag

SEQ ID NO: 70365 - DNA, 18 bp, Artificial Sequence
  Synthetic DNA
tcgttcgactcactaaaa

SEQ ID NO: 70366 - DNA, 18 bp, Artificial Sequence
  Synthetic DNA
tctaacgactgtttaaag

SEQ ID NO: 70367 - DNA, 18 bp, Artificial Sequence
  Synthetic DNA
tcttacgtccaacaatag

SEQ ID NO: 70368 - DNA, 18 bp, Artificial Sequence
  Synthetic DNA
tcttactcatcacttacg

SEQ ID NO: 70369 - DNA, 18 bp, Artificial Sequence
  Synthetic DNA
tcttaggccttactatag

SEQ ID NO: 70370 - DNA, 18 bp, Artificial Sequence
  Synthetic DNA
tctttagtctcactatag

SEQ ID NO: 70371 - DNA, 18 bp, Artificial Sequence
  Synthetic DNA
tctttcaactcattatag

SEQ ID NO: 70372 - DNA, 18 bp, Artificial Sequence
  Synthetic DNA
tctttcgtctcactttag

SEQ ID NO: 70373 - DNA, 18 bp, Artificial Sequence
  Synthetic DNA
tgaagcgagtcgccatag

SEQ ID NO: 70374 - DNA, 18 bp, Artificial Sequence
  Synthetic DNA
tgacaccactaactattg

SEQ ID NO: 70375 - DNA, 18 bp, Artificial Sequence
  Synthetic DNA
tgagacaactcaacatag

SEQ ID NO: 70376 - DNA, 18 bp, Artificial Sequence
  Synthetic DNA
tgatacgatacgctaaag

SEQ ID NO: 70377 - DNA, 18 bp, Artificial Sequence
  Synthetic DNA
tgatactagtcaccaaag

SEQ ID NO: 70378 - DNA, 18 bp, Artificial Sequence
  Synthetic DNA
tgatactccacacttcag

SEQ ID NO: 70379 - DNA, 18 bp, Artificial Sequence
  Synthetic DNA
tgataggagtctctgtgg

SEQ ID NO: 70380 - DNA, 18 bp, Artificial Sequence
  Synthetic DNA
tgatatgaatgagtctag

SEQ ID NO: 70381 - DNA, 18 bp, Artificial Sequence
  Synthetic DNA
tgatgagaatctctatag

SEQ ID NO: 70382 - DNA, 18 bp, Artificial Sequence
  Synthetic DNA
tgatggaacacacttcag

SEQ ID NO: 70383 - DNA, 18 bp, Artificial Sequence
  Synthetic DNA
tgattcaactctccaaag

SEQ ID NO: 70384 - DNA, 18 bp, Artificial Sequence
  Synthetic DNA
tgattcgactcacataag

SEQ ID NO: 70385 - DNA, 18 bp, Artificial Sequence
  Synthetic DNA
tgctacgattaaccatag

SEQ ID NO: 70386 - DNA, 18 bp, Artificial Sequence
  Synthetic DNA
tgctacgtatcactaaag

SEQ ID NO: 70387 - DNA, 18 bp, Artificial Sequence
  Synthetic DNA
tgctattacacactatag

SEQ ID NO: 70388 - DNA, 18 bp, Artificial Sequence
  Synthetic DNA
tgctctgaataattagag

SEQ ID NO: 70389 - DNA, 18 bp, Artificial Sequence
  Synthetic DNA
tggtacgacataggatag

SEQ ID NO: 70390 - DNA, 18 bp, Artificial Sequence
  Synthetic DNA
tggtggatgatactaaag

SEQ ID NO: 70391 - DNA, 18 bp, Artificial Sequence
  Synthetic DNA
tgttaacactcacaattg

SEQ ID NO: 70392 - DNA, 18 bp, Artificial Sequence
  Synthetic DNA
tgttaagaaaccctatag

SEQ ID NO: 70393 - DNA, 18 bp, Artificial Sequence
  Synthetic DNA
tgttaagacacactttag

SEQ ID NO: 70394 - DNA, 18 bp, Artificial Sequence
  Synthetic DNA
tgttacgaatctcaatag

SEQ ID NO: 70395 - DNA, 18 bp, Artificial Sequence
  Synthetic DNA
tgttacgacacattttag

SEQ ID NO: 70396 - DNA, 18 bp, Artificial Sequence
  Synthetic DNA
tgttatgactctctcttg

SEQ ID NO: 70397 - DNA, 18 bp, Artificial Sequence
  Synthetic DNA
tgtttagattcactatag

SEQ ID NO: 70398 - DNA, 18 bp, Artificial Sequence
  Synthetic DNA
tgtttcgactaactaaag

SEQ ID NO: 70399 - DNA, 18 bp, Artificial Sequence
  Synthetic DNA
tgtttcgactcatcttag

SEQ ID NO: 70400 - DNA, 18 bp, Artificial Sequence
  Synthetic DNA
tgtttcgtctcattatag

SEQ ID NO: 70401 - DNA, 18 bp, Artificial Sequence
  Synthetic DNA
tgtttctactcacaacag

SEQ ID NO: 70402 - DNA, 18 bp, Artificial Sequence
  Synthetic DNA
ttaaaagaaacaccatag

SEQ ID NO: 70403 - DNA, 18 bp, Artificial Sequence
  Synthetic DNA
ttaaaccacttatttttg

SEQ ID NO: 70404 - DNA, 18 bp, Artificial Sequence
  Synthetic DNA
ttaaacgaaacacttttg

SEQ ID NO: 70405 - DNA, 18 bp, Artificial Sequence
  Synthetic DNA
ttaaacgactcacaactg

SEQ ID NO: 70406 - DNA, 18 bp, Artificial Sequence
  Synthetic DNA
ttaaacgacttatctctg

SEQ ID NO: 70407 - DNA, 18 bp, Artificial Sequence
  Synthetic DNA
ttaaacgacttgccatag

SEQ ID NO: 70408 - DNA, 18 bp, Artificial Sequence
  Synthetic DNA
ttaaacgtcactttaatg

SEQ ID NO: 70409 - DNA, 18 bp, Artificial Sequence
  Synthetic DNA
ttaaacgtctaattatag

SEQ ID NO: 70410 - DNA, 18 bp, Artificial Sequence
  Synthetic DNA
ttaaactgatcactattg

SEQ ID NO: 70411 - DNA, 18 bp, Artificial Sequence
  Synthetic DNA
ttaaacttttcactatag

SEQ ID NO: 70412 - DNA, 18 bp, Artificial Sequence
  Synthetic DNA
ttaatcgtctcactgtag

SEQ ID NO: 70413 - DNA, 18 bp, Artificial Sequence
  Synthetic DNA
ttacacaactcacaagag

SEQ ID NO: 70414 - DNA, 18 bp, Artificial Sequence
  Synthetic DNA
ttacacatcttactctag

SEQ ID NO: 70415 - DNA, 18 bp, Artificial Sequence
  Synthetic DNA
ttacacgacattttattg

SEQ ID NO: 70416 - DNA, 18 bp, Artificial Sequence
  Synthetic DNA
ttactcaacacacaaccg

SEQ ID NO: 70417 - DNA, 18 bp, Artificial Sequence
  Synthetic DNA
ttactcgacacactctgg

SEQ ID NO: 70418 - DNA, 18 bp, Artificial Sequence
  Synthetic DNA
ttactcgactcaccacag

SEQ ID NO: 70419 - DNA, 18 bp, Artificial Sequence
  Synthetic DNA
ttagacgaatcactcatg

SEQ ID NO: 70420 - DNA, 18 bp, Artificial Sequence
  Synthetic DNA
ttaggcgactcataattg

SEQ ID NO: 70421 - DNA, 18 bp, Artificial Sequence
  Synthetic DNA
ttataactcttactattg

SEQ ID NO: 70422 - DNA, 18 bp, Artificial Sequence
  Synthetic DNA
ttataagtctttgcaaag

SEQ ID NO: 70423 - DNA, 18 bp, Artificial Sequence
  Synthetic DNA
ttatacaacatacaatag

SEQ ID NO: 70424 - DNA, 18 bp, Artificial Sequence
  Synthetic DNA
ttatacatctcacaattg

SEQ ID NO: 70425 - DNA, 18 bp, Artificial Sequence
  Synthetic DNA
ttataccgttcactacag

SEQ ID NO: 70426 - DNA, 18 bp, Artificial Sequence
  Synthetic DNA
ttatacgaaacactaatg

SEQ ID NO: 70427 - DNA, 18 bp, Artificial Sequence
  Synthetic DNA
ttatacgaattcctttag

SEQ ID NO: 70428 - DNA, 18 bp, Artificial Sequence
  Synthetic DNA
ttatacgacaaattaaag

SEQ ID NO: 70429 - DNA, 18 bp, Artificial Sequence
  Synthetic DNA
ttatacgactacctaatg

SEQ ID NO: 70430 - DNA, 18 bp, Artificial Sequence
  Synthetic DNA
ttatacgactccacttag

SEQ ID NO: 70431 - DNA, 18 bp, Artificial Sequence
  Synthetic DNA
ttatacgactccattcag

SEQ ID NO: 70432 - DNA, 18 bp, Artificial Sequence
  Synthetic DNA
ttatacgactctctcacg

SEQ ID NO: 70433 - DNA, 18 bp, Artificial Sequence
  Synthetic DNA
ttatacgacttaatttcg

SEQ ID NO: 70434 - DNA, 18 bp, Artificial Sequence
  Synthetic DNA
ttatacgacttccttaag

SEQ ID NO: 70435 - DNA, 18 bp, Artificial Sequence
  Synthetic DNA
ttatacgacttgatttag

SEQ ID NO: 70436 - DNA, 18 bp, Artificial Sequence
  Synthetic DNA
ttatacgagtctgcaaag

SEQ ID NO: 70437 - DNA, 18 bp, Artificial Sequence
  Synthetic DNA
ttatacgattctttacag

SEQ ID NO: 70438 - DNA, 18 bp, Artificial Sequence
  Synthetic DNA
ttatacgcataactattg

SEQ ID NO: 70439 - DNA, 18 bp, Artificial Sequence
  Synthetic DNA
ttatacgctttacaaaag

SEQ ID NO: 70440 - DNA, 18 bp, Artificial Sequence
  Synthetic DNA
ttatacggctctatattg

SEQ ID NO: 70441 - DNA, 18 bp, Artificial Sequence
  Synthetic DNA
ttatacggcttaccttag

SEQ ID NO: 70442 - DNA, 18 bp, Artificial Sequence
  Synthetic DNA
ttatacggcttagttttg

SEQ ID NO: 70443 - DNA, 18 bp, Artificial Sequence
  Synthetic DNA
ttatacggttctctagag

SEQ ID NO: 70444 - DNA, 18 bp, Artificial Sequence
  Synthetic DNA
ttatacgtctatttatag

SEQ ID NO: 70445 - DNA, 18 bp, Artificial Sequence
  Synthetic DNA
ttatacgtctcacataag

SEQ ID NO: 70446 - DNA, 18 bp, Artificial Sequence
  Synthetic DNA
ttatacgtctcgacctgg

SEQ ID NO: 70447 - DNA, 18 bp, Artificial Sequence
  Synthetic DNA
ttatacgtcttactggag

SEQ ID NO: 70448 - DNA, 18 bp, Artificial Sequence
  Synthetic DNA
ttatacgtgtcattattg

SEQ ID NO: 70449 - DNA, 18 bp, Artificial Sequence
  Synthetic DNA
ttatacgtttcagttaag

SEQ ID NO: 70450 - DNA, 18 bp, Artificial Sequence
  Synthetic DNA
ttatactaatcacttcag

SEQ ID NO: 70451 - DNA, 18 bp, Artificial Sequence
  Synthetic DNA
ttatactaattagtaaag

SEQ ID NO: 70452 - DNA, 18 bp, Artificial Sequence
  Synthetic DNA
ttatactactctcaaatg

SEQ ID NO: 70453 - DNA, 18 bp, Artificial Sequence
  Synthetic DNA
ttatactatccactattg

SEQ ID NO: 70454 - DNA, 18 bp, Artificial Sequence
  Synthetic DNA
ttatacttatcactattg

SEQ ID NO: 70455 - DNA, 18 bp, Artificial Sequence
  Synthetic DNA
ttatacttctcattagga

SEQ ID NO: 70456 - DNA, 18 bp, Artificial Sequence
  Synthetic DNA
ttatatgacacactcccg

SEQ ID NO: 70457 - DNA, 18 bp, Artificial Sequence
  Synthetic DNA
ttatatgagtcactactg

SEQ ID NO: 70458 - DNA, 18 bp, Artificial Sequence
  Synthetic DNA
ttatatgattaacaatag

SEQ ID NO: 70459 - DNA, 18 bp, Artificial Sequence
  Synthetic DNA
ttatatgatttactttag

SEQ ID NO: 70460 - DNA, 18 bp, Artificial Sequence
  Synthetic DNA
ttatatgccccactattg

SEQ ID NO: 70461 - DNA, 18 bp, Artificial Sequence
  Synthetic DNA
ttatattattccctatag

SEQ ID NO: 70462 - DNA, 18 bp, Artificial Sequence
  Synthetic DNA
ttatcccactctatatag

SEQ ID NO: 70463 - DNA, 18 bp, Artificial Sequence
  Synthetic DNA
ttatccgacgcactaatg

SEQ ID NO: 70464 - DNA, 18 bp, Artificial Sequence
  Synthetic DNA
ttatgcaactcacaaaag

SEQ ID NO: 70465 - DNA, 18 bp, Artificial Sequence
  Synthetic DNA
ttatgcctctctctaaag

SEQ ID NO: 70466 - DNA, 18 bp, Artificial Sequence
  Synthetic DNA
ttatgggaatcgctaatg

SEQ ID NO: 70467 - DNA, 18 bp, Artificial Sequence
  Synthetic DNA
ttattagagtcactattg

SEQ ID NO: 70468 - DNA, 18 bp, Artificial Sequence
  Synthetic DNA
ttattcaattcactctag

SEQ ID NO: 70469 - DNA, 18 bp, Artificial Sequence
  Synthetic DNA
ttattcatctcactaaag

SEQ ID NO: 70470 - DNA, 18 bp, Artificial Sequence
  Synthetic DNA
ttattcgacacacaatgg

SEQ ID NO: 70471 - DNA, 18 bp, Artificial Sequence
  Synthetic DNA
ttattcgacactctaaag

SEQ ID NO: 70472 - DNA, 18 bp, Artificial Sequence
  Synthetic DNA
ttattcgactgtctatgg

SEQ ID NO: 70473 - DNA, 18 bp, Artificial Sequence
  Synthetic DNA
ttattcgcctcacactag

SEQ ID NO: 70474 - DNA, 18 bp, Artificial Sequence
  Synthetic DNA
ttattcgcttcactttag

SEQ ID NO: 70475 - DNA, 18 bp, Artificial Sequence
  Synthetic DNA
ttattcgtatgactttag

SEQ ID NO: 70476 - DNA, 18 bp, Artificial Sequence
  Synthetic DNA
ttattcgtctctctattg

SEQ ID NO: 70477 - DNA, 18 bp, Artificial Sequence
  Synthetic DNA
ttattcgtctttctatag

SEQ ID NO: 70478 - DNA, 18 bp, Artificial Sequence
  Synthetic DNA
ttattcgttccactatag

SEQ ID NO: 70479 - DNA, 18 bp, Artificial Sequence
  Synthetic DNA
ttattctgtaaacaatag

SEQ ID NO: 70480 - DNA, 18 bp, Artificial Sequence
  Synthetic DNA
ttatttaactcattattg

SEQ ID NO: 70481 - DNA, 18 bp, Artificial Sequence
  Synthetic DNA
ttatttgactcattattg

SEQ ID NO: 70482 - DNA, 18 bp, Artificial Sequence
  Synthetic DNA
ttatttgtctcactaaag

SEQ ID NO: 70483 - DNA, 18 bp, Artificial Sequence
  Synthetic DNA
ttcaacgattcactttag

SEQ ID NO: 70484 - DNA, 18 bp, Artificial Sequence
  Synthetic DNA
ttcaacgtctaactattg

SEQ ID NO: 70485 - DNA, 18 bp, Artificial Sequence
  Synthetic DNA
ttcaacgttatacttaag

SEQ ID NO: 70486 - DNA, 18 bp, Artificial Sequence
  Synthetic DNA
ttcaactactcattatag

SEQ ID NO: 70487 - DNA, 18 bp, Artificial Sequence
  Synthetic DNA
ttcaccgacataatacag

SEQ ID NO: 70488 - DNA, 18 bp, Artificial Sequence
  Synthetic DNA
ttcaccgacttacaattg

SEQ ID NO: 70489 - DNA, 18 bp, Artificial Sequence
  Synthetic DNA
ttctacaacacactacag

SEQ ID NO: 70490 - DNA, 18 bp, Artificial Sequence
  Synthetic DNA
ttctaccactaagtatag

SEQ ID NO: 70491 - DNA, 18 bp, Artificial Sequence
  Synthetic DNA
ttctacgtccttgaatgg

SEQ ID NO: 70492 - DNA, 18 bp, Artificial Sequence
  Synthetic DNA
ttctacgtcttgcagtag

SEQ ID NO: 70493 - DNA, 18 bp, Artificial Sequence
  Synthetic DNA
ttctatgacccacaatag

SEQ ID NO: 70494 - DNA, 18 bp, Artificial Sequence
  Synthetic DNA
ttctccttctcacaatag

SEQ ID NO: 70495 - DNA, 18 bp, Artificial Sequence
  Synthetic DNA
ttgaacgactgtctatag

SEQ ID NO: 70496 - DNA, 18 bp, Artificial Sequence
  Synthetic DNA
ttgatcgagtctctatag

SEQ ID NO: 70497 - DNA, 18 bp, Artificial Sequence
  Synthetic DNA
ttggacggctcacattag

SEQ ID NO: 70498 - DNA, 18 bp, Artificial Sequence
  Synthetic DNA
ttgtaagactgactaaag

SEQ ID NO: 70499 - DNA, 18 bp, Artificial Sequence
  Synthetic DNA
ttgtacgactctttgtag

SEQ ID NO: 70500 - DNA, 18 bp, Artificial Sequence
  Synthetic DNA
ttgtacgtctaacaatag

SEQ ID NO: 70501 - DNA, 18 bp, Artificial Sequence
  Synthetic DNA
tttaacaactcacaatag

SEQ ID NO: 70502 - DNA, 18 bp, Artificial Sequence
  Synthetic DNA
tttaacgactctatatag

SEQ ID NO: 70503 - DNA, 18 bp, Artificial Sequence
  Synthetic DNA
tttaacgactctctctcg

SEQ ID NO: 70504 - DNA, 18 bp, Artificial Sequence
  Synthetic DNA
tttaacgatgcactatag

SEQ ID NO: 70505 - DNA, 18 bp, Artificial Sequence
  Synthetic DNA
tttaactacacacaatag

SEQ ID NO: 70506 - DNA, 18 bp, Artificial Sequence
  Synthetic DNA
tttcacgtccctctatag

SEQ ID NO: 70507 - DNA, 18 bp, Artificial Sequence
  Synthetic DNA
tttgacgactctctctag

SEQ ID NO: 70508 - DNA, 18 bp, Artificial Sequence
  Synthetic DNA
ttttaagactcacactag

SEQ ID NO: 70509 - DNA, 18 bp, Artificial Sequence
  Synthetic DNA
ttttaattctcaatttag

SEQ ID NO: 70510 - DNA, 18 bp, Artificial Sequence
  Synthetic DNA
ttttacaacttactcaag

SEQ ID NO: 70511 - DNA, 18 bp, Artificial Sequence
  Synthetic DNA
ttttacgactctatattg

SEQ ID NO: 70512 - DNA, 18 bp, Artificial Sequence
  Synthetic DNA
ttttacgacttacacttg

SEQ ID NO: 70513 - DNA, 18 bp, Artificial Sequence
  Synthetic DNA
ttttacgacttacattag

SEQ ID NO: 70514 - DNA, 18 bp, Artificial Sequence
  Synthetic DNA
ttttacgattcaccgtag

SEQ ID NO: 70515 - DNA, 18 bp, Artificial Sequence
  Synthetic DNA
ttttacgtctctgtatag

SEQ ID NO: 70516 - DNA, 18 bp, Artificial Sequence
  Synthetic DNA
ttttacgttttactatag

SEQ ID NO: 70517 - DNA, 18 bp, Artificial Sequence
  Synthetic DNA
ttttactactcacttaag

SEQ ID NO: 70518 - DNA, 18 bp, Artificial Sequence
  Synthetic DNA
ttttatgactttctatgg

SEQ ID NO: 70519 - DNA, 18 bp, Artificial Sequence
  Synthetic DNA
ttttcggactcactaaag

SEQ ID NO: 70520 - DNA, 18 bp, Artificial Sequence
  Synthetic DNA
tttttcgacgcactacag

SEQ ID NO: 70521 - DNA, 18 bp, Artificial Sequence
  Synthetic DNA
tttttcgattcataaaag

SEQ ID NO: 70522 - DNA, 18 bp, Artificial Sequence
  Synthetic DNA
aataacgtctcactctag

SEQ ID NO: 70523 - DNA, 18 bp, Artificial Sequence
  Synthetic DNA
taaaacctctcattttag

SEQ ID NO: 70524 - DNA, 18 bp, Artificial Sequence
  Synthetic DNA
taataagtctcacataag

SEQ ID NO: 70525 - DNA, 18 bp, Artificial Sequence
  Synthetic DNA
taatacaacctacttgag

SEQ ID NO: 70526 - DNA, 18 bp, Artificial Sequence
  Synthetic DNA
tacttcgtctcacaaaag

SEQ ID NO: 70527 - DNA, 18 bp, Artificial Sequence
  Synthetic DNA
tattacaacttacttttg

SEQ ID NO: 70528 - DNA, 18 bp, Artificial Sequence
  Synthetic DNA
ttatactaatcacaattg

SEQ ID NO: 70529 - DNA, 18 bp, Artificial Sequence
  Synthetic DNA
ttattcgacacacaaaag

SEQ ID NO: 70530 - DNA, 18 bp, Artificial Sequence
  Synthetic DNA
ttgtatgtcacactatag

SEQ ID NO: 70531 - DNA, 18 bp, Artificial Sequence
  Synthetic DNA
aaatacgtatcactcaag

SEQ ID NO: 70532 - DNA, 18 bp, Artificial Sequence
  Synthetic DNA
aaattcgactttccatag

SEQ ID NO: 70533 - DNA, 18 bp, Artificial Sequence
  Synthetic DNA
taatacatcacacaacag

SEQ ID NO: 70534 - DNA, 18 bp, Artificial Sequence
  Synthetic DNA
taatacgtccctttgtag

SEQ ID NO: 70535 - DNA, 18 bp, Artificial Sequence
  Synthetic DNA
taattcaactctttattg

SEQ ID NO: 70536 - DNA, 18 bp, Artificial Sequence
  Synthetic DNA
taattctactcacataag

SEQ ID NO: 70537 - DNA, 18 bp, Artificial Sequence
  Synthetic DNA
tattacttcaaactttag

SEQ ID NO: 70538 - DNA, 18 bp, Artificial Sequence
  Synthetic DNA
ttattagactgactttag

SEQ ID NO: 70539 - DNA, 18 bp, Artificial Sequence
  Synthetic DNA
aaaaaagattcattatag

SEQ ID NO: 70540 - DNA, 18 bp, Artificial Sequence
  Synthetic DNA
aaaaacaactctctttag

SEQ ID NO: 70541 - DNA, 18 bp, Artificial Sequence
  Synthetic DNA
aaaaaccactgacgatag

SEQ ID NO: 70542 - DNA, 18 bp, Artificial Sequence
  Synthetic DNA
aaaaacgacactccatgg

SEQ ID NO: 70543 - DNA, 18 bp, Artificial Sequence
  Synthetic DNA
aaaaacgacgctctttag

SEQ ID NO: 70544 - DNA, 18 bp, Artificial Sequence
  Synthetic DNA
aaaaacgcatcactaatg

SEQ ID NO: 70545 - DNA, 18 bp, Artificial Sequence
  Synthetic DNA
aaaaacggctatttatcg

SEQ ID NO: 70546 - DNA, 18 bp, Artificial Sequence
  Synthetic DNA
aaaaacgtctaatattag

SEQ ID NO: 70547 - DNA, 18 bp, Artificial Sequence
  Synthetic DNA
aaaaatgatacactatgg

SEQ ID NO: 70548 - DNA, 18 bp, Artificial Sequence
  Synthetic DNA
aaacacctcgtactctag

SEQ ID NO: 70549 - DNA, 18 bp, Artificial Sequence
  Synthetic DNA
aaacataacccaatatag

SEQ ID NO: 70550 - DNA, 18 bp, Artificial Sequence
  Synthetic DNA
aaacgcgacaccaattag

SEQ ID NO: 70551 - DNA, 18 bp, Artificial Sequence
  Synthetic DNA
aaagaagactcaccattg

SEQ ID NO: 70552 - DNA, 18 bp, Artificial Sequence
  Synthetic DNA
aaataagactctttatgg

SEQ ID NO: 70553 - DNA, 18 bp, Artificial Sequence
  Synthetic DNA
aaatacatctcactagtg

SEQ ID NO: 70554 - DNA, 18 bp, Artificial Sequence
  Synthetic DNA
aaatacgacactcattag

SEQ ID NO: 70555 - DNA, 18 bp, Artificial Sequence
  Synthetic DNA
aaatacgactcgacttag

SEQ ID NO: 70556 - DNA, 18 bp, Artificial Sequence
  Synthetic DNA
aaatacgactctcttatg

SEQ ID NO: 70557 - DNA, 18 bp, Artificial Sequence
  Synthetic DNA
aaatacgcttcacaattg

SEQ ID NO: 70558 - DNA, 18 bp, Artificial Sequence
  Synthetic DNA
aaatacgtattactttag

SEQ ID NO: 70559 - DNA, 18 bp, Artificial Sequence
  Synthetic DNA
aaataggactctcctttg

SEQ ID NO: 70560 - DNA, 18 bp, Artificial Sequence
  Synthetic DNA
aaatatgactcgctcttg

SEQ ID NO: 70561 - DNA, 18 bp, Artificial Sequence
  Synthetic DNA
aaatatgattctctaaag

SEQ ID NO: 70562 - DNA, 18 bp, Artificial Sequence
  Synthetic DNA
aaatccctatcactatag

SEQ ID NO: 70563 - DNA, 18 bp, Artificial Sequence
  Synthetic DNA
aaatccgtctttcttcag

SEQ ID NO: 70564 - DNA, 18 bp, Artificial Sequence
  Synthetic DNA
aaatcgcagacactatag

SEQ ID NO: 70565 - DNA, 18 bp, Artificial Sequence
  Synthetic DNA
aaatctttctcacgatcg

SEQ ID NO: 70566 - DNA, 18 bp, Artificial Sequence
  Synthetic DNA
aaatgcaaaacactattg

SEQ ID NO: 70567 - DNA, 18 bp, Artificial Sequence
  Synthetic DNA
aaatgcgcttcagtgtag

SEQ ID NO: 70568 - DNA, 18 bp, Artificial Sequence
  Synthetic DNA
aaattccactccctttag

SEQ ID NO: 70569 - DNA, 18 bp, Artificial Sequence
  Synthetic DNA
aaattcgacaatctatag

SEQ ID NO: 70570 - DNA, 18 bp, Artificial Sequence
  Synthetic DNA
aaattcgacacacttaag

SEQ ID NO: 70571 - DNA, 18 bp, Artificial Sequence
  Synthetic DNA
aaattcggctcacaaaag

SEQ ID NO: 70572 - DNA, 18 bp, Artificial Sequence
  Synthetic DNA
aaattcgtcgtactaaag

SEQ ID NO: 70573 - DNA, 18 bp, Artificial Sequence
  Synthetic DNA
aaattcgtttctcattag

SEQ ID NO: 70574 - DNA, 18 bp, Artificial Sequence
  Synthetic DNA
aaattggtctccctatag

SEQ ID NO: 70575 - DNA, 18 bp, Artificial Sequence
  Synthetic DNA
aactacgactaacaactg

SEQ ID NO: 70576 - DNA, 18 bp, Artificial Sequence
  Synthetic DNA
aactacgactcagcagcg

SEQ ID NO: 70577 - DNA, 18 bp, Artificial Sequence
  Synthetic DNA
aactacgacttacattag

SEQ ID NO: 70578 - DNA, 18 bp, Artificial Sequence
  Synthetic DNA
aactacgtctaacatatg

SEQ ID NO: 70579 - DNA, 18 bp, Artificial Sequence
  Synthetic DNA
aactacttctcagtcttg

SEQ ID NO: 70580 - DNA, 18 bp, Artificial Sequence
  Synthetic DNA
aacttactttaactatag

SEQ ID NO: 70581 - DNA, 18 bp, Artificial Sequence
  Synthetic DNA
aacttcatctgccaaaag

SEQ ID NO: 70582 - DNA, 18 bp, Artificial Sequence
  Synthetic DNA
aactttgactcacaatag

SEQ ID NO: 70583 - DNA, 18 bp, Artificial Sequence
  Synthetic DNA
aagatcgacacactatag

SEQ ID NO: 70584 - DNA, 18 bp, Artificial Sequence
  Synthetic DNA
aagtacgaatctttatag

SEQ ID NO: 70585 - DNA, 18 bp, Artificial Sequence
  Synthetic DNA
aagtacgattcatcatag

SEQ ID NO: 70586 - DNA, 18 bp, Artificial Sequence
  Synthetic DNA
aataaagacttactagag

SEQ ID NO: 70587 - DNA, 18 bp, Artificial Sequence
  Synthetic DNA
aataacgacacattaaag

SEQ ID NO: 70588 - DNA, 18 bp, Artificial Sequence
  Synthetic DNA
aataaggactcactaaag

SEQ ID NO: 70589 - DNA, 18 bp, Artificial Sequence
  Synthetic DNA
aatcacaactcactatcg

SEQ ID NO: 70590 - DNA, 18 bp, Artificial Sequence
  Synthetic DNA
aattacaactccctgaag

SEQ ID NO: 70591 - DNA, 18 bp, Artificial Sequence
  Synthetic DNA
aattaggcgtcactatag

SEQ ID NO: 70592 - DNA, 18 bp, Artificial Sequence
  Synthetic DNA
aattattacccattacag

SEQ ID NO: 70593 - DNA, 18 bp, Artificial Sequence
  Synthetic DNA
aattccgaattacaactg

SEQ ID NO: 70594 - DNA, 18 bp, Artificial Sequence
  Synthetic DNA
aattgctgctcactatag

SEQ ID NO: 70595 - DNA, 18 bp, Artificial Sequence
  Synthetic DNA
aatttcgactctttattg

SEQ ID NO: 70596 - DNA, 18 bp, Artificial Sequence
  Synthetic DNA
acataccaaactctattg

SEQ ID NO: 70597 - DNA, 18 bp, Artificial Sequence
  Synthetic DNA
acataccactcaatgtag

SEQ ID NO: 70598 - DNA, 18 bp, Artificial Sequence
  Synthetic DNA
acatgagactaacaatag

SEQ ID NO: 70599 - DNA, 18 bp, Artificial Sequence
  Synthetic DNA
agaaaaagctcagttaag

SEQ ID NO: 70600 - DNA, 18 bp, Artificial Sequence
  Synthetic DNA
agaaacaacacactatag

SEQ ID NO: 70601 - DNA, 18 bp, Artificial Sequence
  Synthetic DNA
agaaacgactctttattg

SEQ ID NO: 70602 - DNA, 18 bp, Artificial Sequence
  Synthetic DNA
agaaccgactctctattg

SEQ ID NO: 70603 - DNA, 18 bp, Artificial Sequence
  Synthetic DNA
agaatcgaatcactttag

SEQ ID NO: 70604 - DNA, 18 bp, Artificial Sequence
  Synthetic DNA
agataagactaagtatag

SEQ ID NO: 70605 - DNA, 18 bp, Artificial Sequence
  Synthetic DNA
agatacgactcaatttgg

SEQ ID NO: 70606 - DNA, 18 bp, Artificial Sequence
  Synthetic DNA
agatacgtatcatactcg

SEQ ID NO: 70607 - DNA, 18 bp, Artificial Sequence
  Synthetic DNA
agatacgtctcaatttag

SEQ ID NO: 70608 - DNA, 18 bp, Artificial Sequence
  Synthetic DNA
agttacgactttctaaag

SEQ ID NO: 70609 - DNA, 18 bp, Artificial Sequence
  Synthetic DNA
ataaacttcaccgtatcg

SEQ ID NO: 70610 - DNA, 18 bp, Artificial Sequence
  Synthetic DNA
ataatcgacacactatag

SEQ ID NO: 70611 - DNA, 18 bp, Artificial Sequence
  Synthetic DNA
atacgcatctcactatag

SEQ ID NO: 70612 - DNA, 18 bp, Artificial Sequence
  Synthetic DNA
atatacgacacgctgtag

SEQ ID NO: 70613 - DNA, 18 bp, Artificial Sequence
  Synthetic DNA
atataggactcccattag

SEQ ID NO: 70614 - DNA, 18 bp, Artificial Sequence
  Synthetic DNA
atatatgactaaccatcg

SEQ ID NO: 70615 - DNA, 18 bp, Artificial Sequence
  Synthetic DNA
atatatgactctttatag

SEQ ID NO: 70616 - DNA, 18 bp, Artificial Sequence
  Synthetic DNA
atatattactccctatag

SEQ ID NO: 70617 - DNA, 18 bp, Artificial Sequence
  Synthetic DNA
atatccgatagattttag

SEQ ID NO: 70618 - DNA, 18 bp, Artificial Sequence
  Synthetic DNA
atatgcgaataactttag

SEQ ID NO: 70619 - DNA, 18 bp, Artificial Sequence
  Synthetic DNA
atatgctactcactaaag

SEQ ID NO: 70620 - DNA, 18 bp, Artificial Sequence
  Synthetic DNA
atattcgacttactaaag

SEQ ID NO: 70621 - DNA, 18 bp, Artificial Sequence
  Synthetic DNA
atcttcttctaacaatag

SEQ ID NO: 70622 - DNA, 18 bp, Artificial Sequence
  Synthetic DNA
atggatgtcccaccatag

SEQ ID NO: 70623 - DNA, 18 bp, Artificial Sequence
  Synthetic DNA
atgttatactcacaaaag

SEQ ID NO: 70624 - DNA, 18 bp, Artificial Sequence
  Synthetic DNA
attaacgactaactatag

SEQ ID NO: 70625 - DNA, 18 bp, Artificial Sequence
  Synthetic DNA
atttacgactctctttag

SEQ ID NO: 70626 - DNA, 18 bp, Artificial Sequence
  Synthetic DNA
atttccgactcgctaaag

SEQ ID NO: 70627 - DNA, 18 bp, Artificial Sequence
  Synthetic DNA
atttgcgactcattaaag

SEQ ID NO: 70628 - DNA, 18 bp, Artificial Sequence
  Synthetic DNA
attttcaactcactatag

SEQ ID NO: 70629 - DNA, 18 bp, Artificial Sequence
  Synthetic DNA
caaaaccactcgcaatag

SEQ ID NO: 70630 - DNA, 18 bp, Artificial Sequence
  Synthetic DNA
caactcgactatgatttg

SEQ ID NO: 70631 - DNA, 18 bp, Artificial Sequence
  Synthetic DNA
caatacgatatcccatag

SEQ ID NO: 70632 - DNA, 18 bp, Artificial Sequence
  Synthetic DNA
caatacgtctaacattag

SEQ ID NO: 70633 - DNA, 18 bp, Artificial Sequence
  Synthetic DNA
caatgcgtctcactagtg

SEQ ID NO: 70634 - DNA, 18 bp, Artificial Sequence
  Synthetic DNA
caattcgactcacatttg

SEQ ID NO: 70635 - DNA, 18 bp, Artificial Sequence
  Synthetic DNA
caattcgtctctcaaacg

SEQ ID NO: 70636 - DNA, 18 bp, Artificial Sequence
  Synthetic DNA
cactaatacttacgctag

SEQ ID NO: 70637 - DNA, 18 bp, Artificial Sequence
  Synthetic DNA
cactacgcctgtctatag

SEQ ID NO: 70638 - DNA, 18 bp, Artificial Sequence
  Synthetic DNA
cagtaaaccaaactatag

SEQ ID NO: 70639 - DNA, 18 bp, Artificial Sequence
  Synthetic DNA
cagtacaattatctaaag

SEQ ID NO: 70640 - DNA, 18 bp, Artificial Sequence
  Synthetic DNA
cagtacgactatctttag

SEQ ID NO: 70641 - DNA, 18 bp, Artificial Sequence
  Synthetic DNA
cataacgacgcactttag

SEQ ID NO: 70642 - DNA, 18 bp, Artificial Sequence
  Synthetic DNA
cattaactctcacattag

SEQ ID NO: 70643 - DNA, 18 bp, Artificial Sequence
  Synthetic DNA
cattaccactaacaatag

SEQ ID NO: 70644 - DNA, 18 bp, Artificial Sequence
  Synthetic DNA
cattacggtacactatag

SEQ ID NO: 70645 - DNA, 18 bp, Artificial Sequence
  Synthetic DNA
cattactactcaccattg

SEQ ID NO: 70646 - DNA, 18 bp, Artificial Sequence
  Synthetic DNA
ccatacgaccgaatatag

SEQ ID NO: 70647 - DNA, 18 bp, Artificial Sequence
  Synthetic DNA
ccatgcgaattagtatcg

SEQ ID NO: 70648 - DNA, 18 bp, Artificial Sequence
  Synthetic DNA
cgaataggcttaatctag

SEQ ID NO: 70649 - DNA, 18 bp, Artificial Sequence
  Synthetic DNA
cgatacgactctcattcg

SEQ ID NO: 70650 - DNA, 18 bp, Artificial Sequence
  Synthetic DNA
ctaaacgactcactaatg

SEQ ID NO: 70651 - DNA, 18 bp, Artificial Sequence
  Synthetic DNA
ctaaacgactcactcgag

SEQ ID NO: 70652 - DNA, 18 bp, Artificial Sequence
  Synthetic DNA
ctaatcgactcagtaaag

SEQ ID NO: 70653 - DNA, 18 bp, Artificial Sequence
  Synthetic DNA
ctacacatcacacactag

SEQ ID NO: 70654 - DNA, 18 bp, Artificial Sequence
  Synthetic DNA
ctatacaactcacttaag

SEQ ID NO: 70655 - DNA, 18 bp, Artificial Sequence
  Synthetic DNA
ctatacgattctcaatcg

SEQ ID NO: 70656 - DNA, 18 bp, Artificial Sequence
  Synthetic DNA
ctatatgactcacaatgg

SEQ ID NO: 70657 - DNA, 18 bp, Artificial Sequence
  Synthetic DNA
ctattcgacacactactg

SEQ ID NO: 70658 - DNA, 18 bp, Artificial Sequence
  Synthetic DNA
ctcaacgactcacactag

SEQ ID NO: 70659 - DNA, 18 bp, Artificial Sequence
  Synthetic DNA
ctgtaagacattcaaaag

SEQ ID NO: 70660 - DNA, 18 bp, Artificial Sequence
  Synthetic DNA
ctttacgacgcagcatag

SEQ ID NO: 70661 - DNA, 18 bp, Artificial Sequence
  Synthetic DNA
ctttacgtctctctattg

SEQ ID NO: 70662 - DNA, 18 bp, Artificial Sequence
  Synthetic DNA
cttttccactcactgtag

SEQ ID NO: 70663 - DNA, 18 bp, Artificial Sequence
  Synthetic DNA
gaataagtctctatacag

SEQ ID NO: 70664 - DNA, 18 bp, Artificial Sequence
  Synthetic DNA
gaatacgacatactcctg

SEQ ID NO: 70665 - DNA, 18 bp, Artificial Sequence
  Synthetic DNA
gaataggacacattacag

SEQ ID NO: 70666 - DNA, 18 bp, Artificial Sequence
  Synthetic DNA
gaatccgacacacttttg

SEQ ID NO: 70667 - DNA, 18 bp, Artificial Sequence
  Synthetic DNA
gaatgaaacacactatag

SEQ ID NO: 70668 - DNA, 18 bp, Artificial Sequence
  Synthetic DNA
gaattctaatccctgtag

SEQ ID NO: 70669 - DNA, 18 bp, Artificial Sequence
  Synthetic DNA
gaattggcctcactgaag

SEQ ID NO: 70670 - DNA, 18 bp, Artificial Sequence
  Synthetic DNA
gcatacggctcattagag

SEQ ID NO: 70671 - DNA, 18 bp, Artificial Sequence
  Synthetic DNA
ggatacgacaccctacag

SEQ ID NO: 70672 - DNA, 18 bp, Artificial Sequence
  Synthetic DNA
gtacacccctaactttag

SEQ ID NO: 70673 - DNA, 18 bp, Artificial Sequence
  Synthetic DNA
gtatccaacttactatag

SEQ ID NO: 70674 - DNA, 18 bp, Artificial Sequence
  Synthetic DNA
gtattcgtcactccatag

SEQ ID NO: 70675 - DNA, 18 bp, Artificial Sequence
  Synthetic DNA
gttaacgactcgctatag

SEQ ID NO: 70676 - DNA, 18 bp, Artificial Sequence
  Synthetic DNA
gttttcgaaacactatag

SEQ ID NO: 70677 - DNA, 18 bp, Artificial Sequence
  Synthetic DNA
taaaaagacttacttatg

SEQ ID NO: 70678 - DNA, 18 bp, Artificial Sequence
  Synthetic DNA
taaaaagtcttaacatag

SEQ ID NO: 70679 - DNA, 18 bp, Artificial Sequence
  Synthetic DNA
taaaaatactcatttaag

SEQ ID NO: 70680 - DNA, 18 bp, Artificial Sequence
  Synthetic DNA
taaaacaacccagtattg

SEQ ID NO: 70681 - DNA, 18 bp, Artificial Sequence
  Synthetic DNA
taaaacatctcattattg

SEQ ID NO: 70682 - DNA, 18 bp, Artificial Sequence
  Synthetic DNA
taaaaccaatcatttcag

SEQ ID NO: 70683 - DNA, 18 bp, Artificial Sequence
  Synthetic DNA
taaaacgacacagattag

SEQ ID NO: 70684 - DNA, 18 bp, Artificial Sequence
  Synthetic DNA
taaaacgactaattcttg

SEQ ID NO: 70685 - DNA, 18 bp, Artificial Sequence
  Synthetic DNA
taaaacgactagataaag

SEQ ID NO: 70686 - DNA, 18 bp, Artificial Sequence
  Synthetic DNA
taaaacgactctttccag

SEQ ID NO: 70687 - DNA, 18 bp, Artificial Sequence
  Synthetic DNA
taaaacgatactctttag

SEQ ID NO: 70688 - DNA, 18 bp, Artificial Sequence
  Synthetic DNA
taaaacgattctatttag

SEQ ID NO: 70689 - DNA, 18 bp, Artificial Sequence
  Synthetic DNA
taaaacgattctctcaag

SEQ ID NO: 70690 - DNA, 18 bp, Artificial Sequence
  Synthetic DNA
taaaacggcacacaatgg

SEQ ID NO: 70691 - DNA, 18 bp, Artificial Sequence
  Synthetic DNA
taaaacgtattattatcg

SEQ ID NO: 70692 - DNA, 18 bp, Artificial Sequence
  Synthetic DNA
taaaacgtctcacatagg

SEQ ID NO: 70693 - DNA, 18 bp, Artificial Sequence
  Synthetic DNA
taaaacgtctttatatag

SEQ ID NO: 70694 - DNA, 18 bp, Artificial Sequence
  Synthetic DNA
taaaactactgacattag

SEQ ID NO: 70695 - DNA, 18 bp, Artificial Sequence
  Synthetic DNA
taaaactccacaatatcg

SEQ ID NO: 70696 - DNA, 18 bp, Artificial Sequence
  Synthetic DNA
taaaacttctcgcttatg

SEQ ID NO: 70697 - DNA, 18 bp, Artificial Sequence
  Synthetic DNA
taaaagaacttactttcg

SEQ ID NO: 70698 - DNA, 18 bp, Artificial Sequence
  Synthetic DNA
taaaaggacactcttaag

SEQ ID NO: 70699 - DNA, 18 bp, Artificial Sequence
  Synthetic DNA
taaaaggcttcgctatag

SEQ ID NO: 70700 - DNA, 18 bp, Artificial Sequence
  Synthetic DNA
taaaatgaccaagtattg

SEQ ID NO: 70701 - DNA, 18 bp, Artificial Sequence
  Synthetic DNA
taaaattactctttatag

SEQ ID NO: 70702 - DNA, 18 bp, Artificial Sequence
  Synthetic DNA
taaaccgattcagcatag

SEQ ID NO: 70703 - DNA, 18 bp, Artificial Sequence
  Synthetic DNA
taaagaggctcaattttg

SEQ ID NO: 70704 - DNA, 18 bp, Artificial Sequence
  Synthetic DNA
taaagcgaatcacaattg

SEQ ID NO: 70705 - DNA, 18 bp, Artificial Sequence
  Synthetic DNA
taaagcgacacattattg

SEQ ID NO: 70706 - DNA, 18 bp, Artificial Sequence
  Synthetic DNA
taaagcgacatacaatag

SEQ ID NO: 70707 - DNA, 18 bp, Artificial Sequence
  Synthetic DNA
taaatacacccactaaag

SEQ ID NO: 70708 - DNA, 18 bp, Artificial Sequence
  Synthetic DNA
taaatagcctctctttag

SEQ ID NO: 70709 - DNA, 18 bp, Artificial Sequence
  Synthetic DNA
taaatagccttaccagag

SEQ ID NO: 70710 - DNA, 18 bp, Artificial Sequence
  Synthetic DNA
taaatatactgccaacag

SEQ ID NO: 70711 - DNA, 18 bp, Artificial Sequence
  Synthetic DNA
taaatcaacgccataaag

SEQ ID NO: 70712 - DNA, 18 bp, Artificial Sequence
  Synthetic DNA
taaatcaactcacaatcg

SEQ ID NO: 70713 - DNA, 18 bp, Artificial Sequence
  Synthetic DNA
taaatcaagacactatag

SEQ ID NO: 70714 - DNA, 18 bp, Artificial Sequence
  Synthetic DNA
taaatcgacacacttaag

SEQ ID NO: 70715 - DNA, 18 bp, Artificial Sequence
  Synthetic DNA
taaatcgacgctctaatg

SEQ ID NO: 70716 - DNA, 18 bp, Artificial Sequence
  Synthetic DNA
taaatcgactcactcatg

SEQ ID NO: 70717 - DNA, 18 bp, Artificial Sequence
  Synthetic DNA
taaatcgattcattattg

SEQ ID NO: 70718 - DNA, 18 bp, Artificial Sequence
  Synthetic DNA
taacaacactaacataag

SEQ ID NO: 70719 - DNA, 18 bp, Artificial Sequence
  Synthetic DNA
taacaagacaccttatag

SEQ ID NO: 70720 - DNA, 18 bp, Artificial Sequence
  Synthetic DNA
taacaagacctacaatag

SEQ ID NO: 70721 - DNA, 18 bp, Artificial Sequence
  Synthetic DNA
taacaagtctcacttttg

SEQ ID NO: 70722 - DNA, 18 bp, Artificial Sequence
  Synthetic DNA
taacaagtttcacaattg

SEQ ID NO: 70723 - DNA, 18 bp, Artificial Sequence
  Synthetic DNA
taacaatactcacttctg

SEQ ID NO: 70724 - DNA, 18 bp, Artificial Sequence
  Synthetic DNA
taacacaacacattattg

SEQ ID NO: 70725 - DNA, 18 bp, Artificial Sequence
  Synthetic DNA
taacacaacattgcatag

SEQ ID NO: 70726 - DNA, 18 bp, Artificial Sequence
  Synthetic DNA
taacacgtcacagcatag

SEQ ID NO: 70727 - DNA, 18 bp, Artificial Sequence
  Synthetic DNA
taacacgtcaccctctag

SEQ ID NO: 70728 - DNA, 18 bp, Artificial Sequence
  Synthetic DNA
taacacgtttaaaataag

SEQ ID NO: 70729 - DNA, 18 bp, Artificial Sequence
  Synthetic DNA
taacatgacacacatttg

SEQ ID NO: 70730 - DNA, 18 bp, Artificial Sequence
  Synthetic DNA
taacatggcacactatgg

SEQ ID NO: 70731 - DNA, 18 bp, Artificial Sequence
  Synthetic DNA
taacatgtttcactacag

SEQ ID NO: 70732 - DNA, 18 bp, Artificial Sequence
  Synthetic DNA
taacccgtctctctttag

SEQ ID NO: 70733 - DNA, 18 bp, Artificial Sequence
  Synthetic DNA
taactatattcactattg

SEQ ID NO: 70734 - DNA, 18 bp, Artificial Sequence
  Synthetic DNA
taactcgactcagcattg

SEQ ID NO: 70735 - DNA, 18 bp, Artificial Sequence
  Synthetic DNA
taactcgtcacattgaag

SEQ ID NO: 70736 - DNA, 18 bp, Artificial Sequence
  Synthetic DNA
taactcttctctcataag

SEQ ID NO: 70737 - DNA, 18 bp, Artificial Sequence
  Synthetic DNA
taactggtatcactaaag

SEQ ID NO: 70738 - DNA, 18 bp, Artificial Sequence
  Synthetic DNA
taagaccactctattaag

SEQ ID NO: 70739 - DNA, 18 bp, Artificial Sequence
  Synthetic DNA
taagacgatactatgcag

SEQ ID NO: 70740 - DNA, 18 bp, Artificial Sequence
  Synthetic DNA
taagacttctctctatgg

SEQ ID NO: 70741 - DNA, 18 bp, Artificial Sequence
  Synthetic DNA
taataaaatccactatcg

SEQ ID NO: 70742 - DNA, 18 bp, Artificial Sequence
  Synthetic DNA
taataacactaacttttg

SEQ ID NO: 70743 - DNA, 18 bp, Artificial Sequence
  Synthetic DNA
taataagactaacttatg

SEQ ID NO: 70744 - DNA, 18 bp, Artificial Sequence
  Synthetic DNA
taataagactcaatgggg

SEQ ID NO: 70745 - DNA, 18 bp, Artificial Sequence
  Synthetic DNA
taataagactctcttccg

SEQ ID NO: 70746 - DNA, 18 bp, Artificial Sequence
  Synthetic DNA
taataagatactctttag

SEQ ID NO: 70747 - DNA, 18 bp, Artificial Sequence
  Synthetic DNA
taatacaacacatatttg

SEQ ID NO: 70748 - DNA, 18 bp, Artificial Sequence
  Synthetic DNA
taatacaactctctcatg

SEQ ID NO: 70749 - DNA, 18 bp, Artificial Sequence
  Synthetic DNA
taatacaagtcgctatca

SEQ ID NO: 70750 - DNA, 18 bp, Artificial Sequence
  Synthetic DNA
taatacactatcttctag

SEQ ID NO: 70751 - DNA, 18 bp, Artificial Sequence
  Synthetic DNA
taatacatccgactaaag

SEQ ID NO: 70752 - DNA, 18 bp, Artificial Sequence
  Synthetic DNA
taatacatctctcaaaag

SEQ ID NO: 70753 - DNA, 18 bp, Artificial Sequence
  Synthetic DNA
taatacatcttaatacag

SEQ ID NO: 70754 - DNA, 18 bp, Artificial Sequence
  Synthetic DNA
taataccacaatcaatag

SEQ ID NO: 70755 - DNA, 18 bp, Artificial Sequence
  Synthetic DNA
taataccacatacttttg

SEQ ID NO: 70756 - DNA, 18 bp, Artificial Sequence
  Synthetic DNA
taataccactcctttatg

SEQ ID NO: 70757 - DNA, 18 bp, Artificial Sequence
  Synthetic DNA
taatacgaaattatatag

SEQ ID NO: 70758 - DNA, 18 bp, Artificial Sequence
  Synthetic DNA
taatacgactgtcttatg

SEQ ID NO: 70759 - DNA, 18 bp, Artificial Sequence
  Synthetic DNA
taatacgagcttcttttg

SEQ ID NO: 70760 - DNA, 18 bp, Artificial Sequence
  Synthetic DNA
taatacgagtctcgagtg

SEQ ID NO: 70761 - DNA, 18 bp, Artificial Sequence
  Synthetic DNA
taatacgatactatattg

SEQ ID NO: 70762 - DNA, 18 bp, Artificial Sequence
  Synthetic DNA
taatacgatcctacatag

SEQ ID NO: 70763 - DNA, 18 bp, Artificial Sequence
  Synthetic DNA
taatacgatgtaacaaag

SEQ ID NO: 70764 - DNA, 18 bp, Artificial Sequence
  Synthetic DNA
taatacgattcacatacg

SEQ ID NO: 70765 - DNA, 18 bp, Artificial Sequence
  Synthetic DNA
taatacgcttcattttcg

SEQ ID NO: 70766 - DNA, 18 bp, Artificial Sequence
  Synthetic DNA
taatacggctctcccttg

SEQ ID NO: 70767 - DNA, 18 bp, Artificial Sequence
  Synthetic DNA
taatacgtatatcaatag

SEQ ID NO: 70768 - DNA, 18 bp, Artificial Sequence
  Synthetic DNA
taatacgtctcaattctg

SEQ ID NO: 70769 - DNA, 18 bp, Artificial Sequence
  Synthetic DNA
taatacgtctccttttcg

SEQ ID NO: 70770 - DNA, 18 bp, Artificial Sequence
  Synthetic DNA
taatacgtctctatgttg

SEQ ID NO: 70771 - DNA, 18 bp, Artificial Sequence
  Synthetic DNA
taatacgtcttgcttgag

SEQ ID NO: 70772 - DNA, 18 bp, Artificial Sequence
  Synthetic DNA
taatacgttacataatag

SEQ ID NO: 70773 - DNA, 18 bp, Artificial Sequence
  Synthetic DNA
taatacgttactcaatag

SEQ ID NO: 70774 - DNA, 18 bp, Artificial Sequence
  Synthetic DNA
taatacgttagaatatag

SEQ ID NO: 70775 - DNA, 18 bp, Artificial Sequence
  Synthetic DNA
taatacgtttagctattg

SEQ ID NO: 70776 - DNA, 18 bp, Artificial Sequence
  Synthetic DNA
taatacgtttccttacag

SEQ ID NO: 70777 - DNA, 18 bp, Artificial Sequence
  Synthetic DNA
taatacgtttctcttaag

SEQ ID NO: 70778 - DNA, 18 bp, Artificial Sequence
  Synthetic DNA
taatactaatgtcgattg

SEQ ID NO: 70779 - DNA, 18 bp, Artificial Sequence
  Synthetic DNA
taatactacagtctagtg

SEQ ID NO: 70780 - DNA, 18 bp, Artificial Sequence
  Synthetic DNA
taatacttatcgctattg

SEQ ID NO: 70781 - DNA, 18 bp, Artificial Sequence
  Synthetic DNA
taatacttcccaccttag

SEQ ID NO: 70782 - DNA, 18 bp, Artificial Sequence
  Synthetic DNA
taatacttctcacaaatg

SEQ ID NO: 70783 - DNA, 18 bp, Artificial Sequence
  Synthetic DNA
taatacttctgtccctag

SEQ ID NO: 70784 - DNA, 18 bp, Artificial Sequence
  Synthetic DNA
taatactttgcactcttg

SEQ ID NO: 70785 - DNA, 18 bp, Artificial Sequence
  Synthetic DNA
taataggaatcactcgtg

SEQ ID NO: 70786 - DNA, 18 bp, Artificial Sequence
  Synthetic DNA
taataggatacaccgaag

SEQ ID NO: 70787 - DNA, 18 bp, Artificial Sequence
  Synthetic DNA
taataggtcacactaatg

SEQ ID NO: 70788 - DNA, 18 bp, Artificial Sequence
  Synthetic DNA
taataggttttactttag

SEQ ID NO: 70789 - DNA, 18 bp, Artificial Sequence
  Synthetic DNA
taatatacattcccattg

SEQ ID NO: 70790 - DNA, 18 bp, Artificial Sequence
  Synthetic DNA
taatatcgctcaatcaag

SEQ ID NO: 70791 - DNA, 18 bp, Artificial Sequence
  Synthetic DNA
taatatgtctcacatttg

SEQ ID NO: 70792 - DNA, 18 bp, Artificial Sequence
  Synthetic DNA
taatatgtctttatatag

SEQ ID NO: 70793 - DNA, 18 bp, Artificial Sequence
  Synthetic DNA
taatattatacacattgg

SEQ ID NO: 70794 - DNA, 18 bp, Artificial Sequence
  Synthetic DNA
taatattattctctattg

SEQ ID NO: 70795 - DNA, 18 bp, Artificial Sequence
  Synthetic DNA
taatcaaacgcactgtag

SEQ ID NO: 70796 - DNA, 18 bp, Artificial Sequence
  Synthetic DNA
taatcagtctttctatag

SEQ ID NO: 70797 - DNA, 18 bp, Artificial Sequence
  Synthetic DNA
taatccaaatctgttacg

SEQ ID NO: 70798 - DNA, 18 bp, Artificial Sequence
  Synthetic DNA
taatccaacttacaattg

SEQ ID NO: 70799 - DNA, 18 bp, Artificial Sequence
  Synthetic DNA
taatccatctctctgtag

SEQ ID NO: 70800 - DNA, 18 bp, Artificial Sequence
  Synthetic DNA
taatccgaatcacctatg

SEQ ID NO: 70801 - DNA, 18 bp, Artificial Sequence
  Synthetic DNA
taatccgacacacttacg

SEQ ID NO: 70802 - DNA, 18 bp, Artificial Sequence
  Synthetic DNA
taatccgattatctttag

SEQ ID NO: 70803 - DNA, 18 bp, Artificial Sequence
  Synthetic DNA
taatccgtcacacttaag

SEQ ID NO: 70804 - DNA, 18 bp, Artificial Sequence
  Synthetic DNA
taatcctattgactctcg

SEQ ID NO: 70805 - DNA, 18 bp, Artificial Sequence
  Synthetic DNA
taatctgtctccctaaag

SEQ ID NO: 70806 - DNA, 18 bp, Artificial Sequence
  Synthetic DNA
taatgagtctaactattg

SEQ ID NO: 70807 - DNA, 18 bp, Artificial Sequence
  Synthetic DNA
taatgcaacacacataag

SEQ ID NO: 70808 - DNA, 18 bp, Artificial Sequence
  Synthetic DNA
taatgcgaaggacagtag

SEQ ID NO: 70809 - DNA, 18 bp, Artificial Sequence
  Synthetic DNA
taatgctatacgctatag

SEQ ID NO: 70810 - DNA, 18 bp, Artificial Sequence
  Synthetic DNA
taatgtacctcaatatag

SEQ ID NO: 70811 - DNA, 18 bp, Artificial Sequence
  Synthetic DNA
taatgtatctcactacag

SEQ ID NO: 70812 - DNA, 18 bp, Artificial Sequence
  Synthetic DNA
taattaaactatctatag

SEQ ID NO: 70813 - DNA, 18 bp, Artificial Sequence
  Synthetic DNA
taattagactcacaaacg

SEQ ID NO: 70814 - DNA, 18 bp, Artificial Sequence
  Synthetic DNA
taattagactctttttag

SEQ ID NO: 70815 - DNA, 18 bp, Artificial Sequence
  Synthetic DNA
taattagctacactatgg

SEQ ID NO: 70816 - DNA, 18 bp, Artificial Sequence
  Synthetic DNA
taattcaacacaatatgg

SEQ ID NO: 70817 - DNA, 18 bp, Artificial Sequence
  Synthetic DNA
taattcaacacacagtag

SEQ ID NO: 70818 - DNA, 18 bp, Artificial Sequence
  Synthetic DNA
taattcaactcaaattag

SEQ ID NO: 70819 - DNA, 18 bp, Artificial Sequence
  Synthetic DNA
taattcaactcataaaag

SEQ ID NO: 70820 - DNA, 18 bp, Artificial Sequence
  Synthetic DNA
taattcaagtcagtattg

SEQ ID NO: 70821 - DNA, 18 bp, Artificial Sequence
  Synthetic DNA
taattcatctcactcttg

SEQ ID NO: 70822 - DNA, 18 bp, Artificial Sequence
  Synthetic DNA
taattcatctcccattag

SEQ ID NO: 70823 - DNA, 18 bp, Artificial Sequence
  Synthetic DNA
taattcatctctctttag

SEQ ID NO: 70824 - DNA, 18 bp, Artificial Sequence
  Synthetic DNA
taattcatcttactattg

SEQ ID NO: 70825 - DNA, 18 bp, Artificial Sequence
  Synthetic DNA
taattcgaactacagtag

SEQ ID NO: 70826 - DNA, 18 bp, Artificial Sequence
  Synthetic DNA
taattcgaatcacattgg

SEQ ID NO: 70827 - DNA, 18 bp, Artificial Sequence
  Synthetic DNA
taattcgacatgcagttg

SEQ ID NO: 70828 - DNA, 18 bp, Artificial Sequence
  Synthetic DNA
taattcgtcaacctatcg

SEQ ID NO: 70829 - DNA, 18 bp, Artificial Sequence
  Synthetic DNA
taattcgtccctcaatag

SEQ ID NO: 70830 - DNA, 18 bp, Artificial Sequence
  Synthetic DNA
taattcgtctccataaag

SEQ ID NO: 70831 - DNA, 18 bp, Artificial Sequence
  Synthetic DNA
taattcgtctctcgaatg

SEQ ID NO: 70832 - DNA, 18 bp, Artificial Sequence
  Synthetic DNA
taattctaatcattattg

SEQ ID NO: 70833 - DNA, 18 bp, Artificial Sequence
  Synthetic DNA
taattctacacacaattg

SEQ ID NO: 70834 - DNA, 18 bp, Artificial Sequence
  Synthetic DNA
taattctactcatttaag

SEQ ID NO: 70835 - DNA, 18 bp, Artificial Sequence
  Synthetic DNA
taattctactctatctag

SEQ ID NO: 70836 - DNA, 18 bp, Artificial Sequence
  Synthetic DNA
taattcttctaactctag

SEQ ID NO: 70837 - DNA, 18 bp, Artificial Sequence
  Synthetic DNA
taatttgaatcacattag

SEQ ID NO: 70838 - DNA, 18 bp, Artificial Sequence
  Synthetic DNA
taatttgaatcattatga

SEQ ID NO: 70839 - DNA, 18 bp, Artificial Sequence
  Synthetic DNA
taatttgagtcactcaag

SEQ ID NO: 70840 - DNA, 18 bp, Artificial Sequence
  Synthetic DNA
taatttgcctaactattg

SEQ ID NO: 70841 - DNA, 18 bp, Artificial Sequence
  Synthetic DNA
tacaacgaggccctatag

SEQ ID NO: 70842 - DNA, 18 bp, Artificial Sequence
  Synthetic DNA
tactaagattcacaatgg

SEQ ID NO: 70843 - DNA, 18 bp, Artificial Sequence
  Synthetic DNA
tactaagtctctctttcg

SEQ ID NO: 70844 - DNA, 18 bp, Artificial Sequence
  Synthetic DNA
tactacaatacattatag

SEQ ID NO: 70845 - DNA, 18 bp, Artificial Sequence
  Synthetic DNA
tactacctctcactgtgg

SEQ ID NO: 70846 - DNA, 18 bp, Artificial Sequence
  Synthetic DNA
tactactacacacatttg

SEQ ID NO: 70847 - DNA, 18 bp, Artificial Sequence
  Synthetic DNA
tactatcactaattgtgg

SEQ ID NO: 70848 - DNA, 18 bp, Artificial Sequence
  Synthetic DNA
tactctgactcacgttag

SEQ ID NO: 70849 - DNA, 18 bp, Artificial Sequence
  Synthetic DNA
tactgcgactcgcttgag

SEQ ID NO: 70850 - DNA, 18 bp, Artificial Sequence
  Synthetic DNA
tacttattctctcaattg

SEQ ID NO: 70851 - DNA, 18 bp, Artificial Sequence
  Synthetic DNA
tacttcgattcacttaag

SEQ ID NO: 70852 - DNA, 18 bp, Artificial Sequence
  Synthetic DNA
tacttcgcatctctttag

SEQ ID NO: 70853 - DNA, 18 bp, Artificial Sequence
  Synthetic DNA
tacttttactcacttaag

SEQ ID NO: 70854 - DNA, 18 bp, Artificial Sequence
  Synthetic DNA
tagaacgattccctacag

SEQ ID NO: 70855 - DNA, 18 bp, Artificial Sequence
  Synthetic DNA
tagcacaacgcactcttg

SEQ ID NO: 70856 - DNA, 18 bp, Artificial Sequence
  Synthetic DNA
tagcacgagtctctattg

SEQ ID NO: 70857 - DNA, 18 bp, Artificial Sequence
  Synthetic DNA
tagtaccacttattattg

SEQ ID NO: 70858 - DNA, 18 bp, Artificial Sequence
  Synthetic DNA
tagtacgactcaattccg

SEQ ID NO: 70859 - DNA, 18 bp, Artificial Sequence
  Synthetic DNA
tagtacgacttagctaag

SEQ ID NO: 70860 - DNA, 18 bp, Artificial Sequence
  Synthetic DNA
tagtactatcagctatag

SEQ ID NO: 70861 - DNA, 18 bp, Artificial Sequence
  Synthetic DNA
tagtacttctcacatttg

SEQ ID NO: 70862 - DNA, 18 bp, Artificial Sequence
  Synthetic DNA
tagtagatttcatttaag

SEQ ID NO: 70863 - DNA, 18 bp, Artificial Sequence
  Synthetic DNA
tagtatgacacattattg

SEQ ID NO: 70864 - DNA, 18 bp, Artificial Sequence
  Synthetic DNA
tagtgagactcacaaaag

SEQ ID NO: 70865 - DNA, 18 bp, Artificial Sequence
  Synthetic DNA
tagttcgaaacattaaag

SEQ ID NO: 70866 - DNA, 18 bp, Artificial Sequence
  Synthetic DNA
tataacaacacccaattg

SEQ ID NO: 70867 - DNA, 18 bp, Artificial Sequence
  Synthetic DNA
tataacaactcactcttg

SEQ ID NO: 70868 - DNA, 18 bp, Artificial Sequence
  Synthetic DNA
tataacgacccattattg

SEQ ID NO: 70869 - DNA, 18 bp, Artificial Sequence
  Synthetic DNA
tataacgactctttatcg

SEQ ID NO: 70870 - DNA, 18 bp, Artificial Sequence
  Synthetic DNA
tataacgactggctattg

SEQ ID NO: 70871 - DNA, 18 bp, Artificial Sequence
  Synthetic DNA
tataacgtctaaataatg

SEQ ID NO: 70872 - DNA, 18 bp, Artificial Sequence
  Synthetic DNA
tataatgacacactaaag

SEQ ID NO: 70873 - DNA, 18 bp, Artificial Sequence
  Synthetic DNA
tataatgattcacaatag

SEQ ID NO: 70874 - DNA, 18 bp, Artificial Sequence
  Synthetic DNA
tatatctacccactatag

SEQ ID NO: 70875 - DNA, 18 bp, Artificial Sequence
  Synthetic DNA
tatattgaatcactatag

SEQ ID NO: 70876 - DNA, 18 bp, Artificial Sequence
  Synthetic DNA
tatcaggactcacaatgg

SEQ ID NO: 70877 - DNA, 18 bp, Artificial Sequence
  Synthetic DNA
tatcaggccaaactatag

SEQ ID NO: 70878 - DNA, 18 bp, Artificial Sequence
  Synthetic DNA
tatcccaactcactttag

SEQ ID NO: 70879 - DNA, 18 bp, Artificial Sequence
  Synthetic DNA
tatcgcgattcagtattg

SEQ ID NO: 70880 - DNA, 18 bp, Artificial Sequence
  Synthetic DNA
tatcgtgatttaccatag

SEQ ID NO: 70881 - DNA, 18 bp, Artificial Sequence
  Synthetic DNA
tatctcgactctcaactg

SEQ ID NO: 70882 - DNA, 18 bp, Artificial Sequence
  Synthetic DNA
tatgacgtcttgctatag

SEQ ID NO: 70883 - DNA, 18 bp, Artificial Sequence
  Synthetic DNA
tattaacactcaatattg

SEQ ID NO: 70884 - DNA, 18 bp, Artificial Sequence
  Synthetic DNA
tattaagtcaccctatag

SEQ ID NO: 70885 - DNA, 18 bp, Artificial Sequence
  Synthetic DNA
tattaagtctaacaatag

SEQ ID NO: 70886 - DNA, 18 bp, Artificial Sequence
  Synthetic DNA
tattaatagtacctatag

SEQ ID NO: 70887 - DNA, 18 bp, Artificial Sequence
  Synthetic DNA
tattaccacccacgatcg

SEQ ID NO: 70888 - DNA, 18 bp, Artificial Sequence
  Synthetic DNA
tattaccactaaccatcg

SEQ ID NO: 70889 - DNA, 18 bp, Artificial Sequence
  Synthetic DNA
tattacgaatcttgattg

SEQ ID NO: 70890 - DNA, 18 bp, Artificial Sequence
  Synthetic DNA
tattacgaatttatatag

SEQ ID NO: 70891 - DNA, 18 bp, Artificial Sequence
  Synthetic DNA
tattacgaccaactaatg

SEQ ID NO: 70892 - DNA, 18 bp, Artificial Sequence
  Synthetic DNA
tattacgactatttatgg

SEQ ID NO: 70893 - DNA, 18 bp, Artificial Sequence
  Synthetic DNA
tattacgactctcttatg

SEQ ID NO: 70894 - DNA, 18 bp, Artificial Sequence
  Synthetic DNA
tattacggcacataaaag

SEQ ID NO: 70895 - DNA, 18 bp, Artificial Sequence
  Synthetic DNA
tattacgtctctcaaaag

SEQ ID NO: 70896 - DNA, 18 bp, Artificial Sequence
  Synthetic DNA
tattactaccctccatag

SEQ ID NO: 70897 - DNA, 18 bp, Artificial Sequence
  Synthetic DNA
tattactactcttctttg

SEQ ID NO: 70898 - DNA, 18 bp, Artificial Sequence
  Synthetic DNA
tattactccactcaaaag

SEQ ID NO: 70899 - DNA, 18 bp, Artificial Sequence
  Synthetic DNA
tattaggaccctctttag

SEQ ID NO: 70900 - DNA, 18 bp, Artificial Sequence
  Synthetic DNA
tattaggactctccattg

SEQ ID NO: 70901 - DNA, 18 bp, Artificial Sequence
  Synthetic DNA
tattatcacacattatag

SEQ ID NO: 70902 - DNA, 18 bp, Artificial Sequence
  Synthetic DNA
tattatgactctctaacg

SEQ ID NO: 70903 - DNA, 18 bp, Artificial Sequence
  Synthetic DNA
tattccgaaataccatag

SEQ ID NO: 70904 - DNA, 18 bp, Artificial Sequence
  Synthetic DNA
tattccgactcattaatg

SEQ ID NO: 70905 - DNA, 18 bp, Artificial Sequence
  Synthetic DNA
tattccttctcaatatag

SEQ ID NO: 70906 - DNA, 18 bp, Artificial Sequence
  Synthetic DNA
tattctgactcgagatcg

SEQ ID NO: 70907 - DNA, 18 bp, Artificial Sequence
  Synthetic DNA
tattctgattcataatag

SEQ ID NO: 70908 - DNA, 18 bp, Artificial Sequence
  Synthetic DNA
tattgcctctgacgatag

SEQ ID NO: 70909 - DNA, 18 bp, Artificial Sequence
  Synthetic DNA
tattgcgactctctcaag

SEQ ID NO: 70910 - DNA, 18 bp, Artificial Sequence
  Synthetic DNA
tatttcagttcaccaatg

SEQ ID NO: 70911 - DNA, 18 bp, Artificial Sequence
  Synthetic DNA
tatttcctctcactattg

SEQ ID NO: 70912 - DNA, 18 bp, Artificial Sequence
  Synthetic DNA
tatttcctcttacaatag

SEQ ID NO: 70913 - DNA, 18 bp, Artificial Sequence
  Synthetic DNA
tatttcgaatctatatag

SEQ ID NO: 70914 - DNA, 18 bp, Artificial Sequence
  Synthetic DNA
tatttcgaatctgtattg

SEQ ID NO: 70915 - DNA, 18 bp, Artificial Sequence
  Synthetic DNA
tatttcgacacacattag

SEQ ID NO: 70916 - DNA, 18 bp, Artificial Sequence
  Synthetic DNA
tatttcgacgtactaaag

SEQ ID NO: 70917 - DNA, 18 bp, Artificial Sequence
  Synthetic DNA
tatttcgactttctatgg

SEQ ID NO: 70918 - DNA, 18 bp, Artificial Sequence
  Synthetic DNA
tatttcgccttacttttg

SEQ ID NO: 70919 - DNA, 18 bp, Artificial Sequence
  Synthetic DNA
tatttcgtctcaaaatag

SEQ ID NO: 70920 - DNA, 18 bp, Artificial Sequence
  Synthetic DNA
tatttggactcacatcag

SEQ ID NO: 70921 - DNA, 18 bp, Artificial Sequence
  Synthetic DNA
tcaaaatacttactatag

SEQ ID NO: 70922 - DNA, 18 bp, Artificial Sequence
  Synthetic DNA
tcaagtgacaaactatag

SEQ ID NO: 70923 - DNA, 18 bp, Artificial Sequence
  Synthetic DNA
tcatacagatcaccaaag

SEQ ID NO: 70924 - DNA, 18 bp, Artificial Sequence
  Synthetic DNA
tcataccgctctcatttg

SEQ ID NO: 70925 - DNA, 18 bp, Artificial Sequence
  Synthetic DNA
tcatacgacaccacatag

SEQ ID NO: 70926 - DNA, 18 bp, Artificial Sequence
  Synthetic DNA
tcatacgattcacttggg

SEQ ID NO: 70927 - DNA, 18 bp, Artificial Sequence
  Synthetic DNA
tcatacgattcgtcaaag

SEQ ID NO: 70928 - DNA, 18 bp, Artificial Sequence
  Synthetic DNA
tcatacgtatgactattg

SEQ ID NO: 70929 - DNA, 18 bp, Artificial Sequence
  Synthetic DNA
tcatacgtctggctactg

SEQ ID NO: 70930 - DNA, 18 bp, Artificial Sequence
  Synthetic DNA
tcatacttaatactatag

SEQ ID NO: 70931 - DNA, 18 bp, Artificial Sequence
  Synthetic DNA
tcataggcctatctttag

SEQ ID NO: 70932 - DNA, 18 bp, Artificial Sequence
  Synthetic DNA
tcatgcgactctcaattg

SEQ ID NO: 70933 - DNA, 18 bp, Artificial Sequence
  Synthetic DNA
tcattcgtttcactctag

SEQ ID NO: 70934 - DNA, 18 bp, Artificial Sequence
  Synthetic DNA
tccacctactcactatag

SEQ ID NO: 70935 - DNA, 18 bp, Artificial Sequence
  Synthetic DNA
tcctacatctcacaaaag

SEQ ID NO: 70936 - DNA, 18 bp, Artificial Sequence
  Synthetic DNA
tcgtaccccgtacaatcg

SEQ ID NO: 70937 - DNA, 18 bp, Artificial Sequence
  Synthetic DNA
tcgttcgtctttctaaag

SEQ ID NO: 70938 - DNA, 18 bp, Artificial Sequence
  Synthetic DNA
tcttacaactcacttttg

SEQ ID NO: 70939 - DNA, 18 bp, Artificial Sequence
  Synthetic DNA
tcttacgaatcacttaag

SEQ ID NO: 70940 - DNA, 18 bp, Artificial Sequence
  Synthetic DNA
tgaaatgactcacttttg

SEQ ID NO: 70941 - DNA, 18 bp, Artificial Sequence
  Synthetic DNA
tgataagaatctctgttg

SEQ ID NO: 70942 - DNA, 18 bp, Artificial Sequence
  Synthetic DNA
tgataagagtcaatagag

SEQ ID NO: 70943 - DNA, 18 bp, Artificial Sequence
  Synthetic DNA
tgatacgacattctttag

SEQ ID NO: 70944 - DNA, 18 bp, Artificial Sequence
  Synthetic DNA
tgatacgtatcactttcg

SEQ ID NO: 70945 - DNA, 18 bp, Artificial Sequence
  Synthetic DNA
tgatacgtccctctatgg

SEQ ID NO: 70946 - DNA, 18 bp, Artificial Sequence
  Synthetic DNA
tgatactactatctatcg

SEQ ID NO: 70947 - DNA, 18 bp, Artificial Sequence
  Synthetic DNA
tgatatggctttctatag

SEQ ID NO: 70948 - DNA, 18 bp, Artificial Sequence
  Synthetic DNA
tgatcagatacactatag

SEQ ID NO: 70949 - DNA, 18 bp, Artificial Sequence
  Synthetic DNA
tgatccgtctcaatagag

SEQ ID NO: 70950 - DNA, 18 bp, Artificial Sequence
  Synthetic DNA
tgattccactaacgattg

SEQ ID NO: 70951 - DNA, 18 bp, Artificial Sequence
  Synthetic DNA
tgattcggatgtttaaag

SEQ ID NO: 70952 - DNA, 18 bp, Artificial Sequence
  Synthetic DNA
tgattcgtctcatcatag

SEQ ID NO: 70953 - DNA, 18 bp, Artificial Sequence
  Synthetic DNA
tgatttgtctctctatag

SEQ ID NO: 70954 - DNA, 18 bp, Artificial Sequence
  Synthetic DNA
tgctacctctcactattg

SEQ ID NO: 70955 - DNA, 18 bp, Artificial Sequence
  Synthetic DNA
tgctcctactcactttag

SEQ ID NO: 70956 - DNA, 18 bp, Artificial Sequence
  Synthetic DNA
tgtaacgacacgctatag

SEQ ID NO: 70957 - DNA, 18 bp, Artificial Sequence
  Synthetic DNA
tgttacatatcaccatag

SEQ ID NO: 70958 - DNA, 18 bp, Artificial Sequence
  Synthetic DNA
tgttaccaccaactatag

SEQ ID NO: 70959 - DNA, 18 bp, Artificial Sequence
  Synthetic DNA
tgttagaacacaaaatag

SEQ ID NO: 70960 - DNA, 18 bp, Artificial Sequence
  Synthetic DNA
tgttatatcttacatcag

SEQ ID NO: 70961 - DNA, 18 bp, Artificial Sequence
  Synthetic DNA
ttaaaagactcacttttg

SEQ ID NO: 70962 - DNA, 18 bp, Artificial Sequence
  Synthetic DNA
ttaaaccgctcactaaag

SEQ ID NO: 70963 - DNA, 18 bp, Artificial Sequence
  Synthetic DNA
ttaaacctctaccaatag

SEQ ID NO: 70964 - DNA, 18 bp, Artificial Sequence
  Synthetic DNA
ttaaacgaatctattttg

SEQ ID NO: 70965 - DNA, 18 bp, Artificial Sequence
  Synthetic DNA
ttaaacgacacacatggg

SEQ ID NO: 70966 - DNA, 18 bp, Artificial Sequence
  Synthetic DNA
ttaaacgactatctaaag

SEQ ID NO: 70967 - DNA, 18 bp, Artificial Sequence
  Synthetic DNA
ttaaacttctcactctag

SEQ ID NO: 70968 - DNA, 18 bp, Artificial Sequence
  Synthetic DNA
ttaaaggatgcactatag

SEQ ID NO: 70969 - DNA, 18 bp, Artificial Sequence
  Synthetic DNA
ttaaatgtctcaatctag

SEQ ID NO: 70970 - DNA, 18 bp, Artificial Sequence
  Synthetic DNA
ttaaccgcctcactaaag

SEQ ID NO: 70971 - DNA, 18 bp, Artificial Sequence
  Synthetic DNA
ttaatagacactatatag

SEQ ID NO: 70972 - DNA, 18 bp, Artificial Sequence
  Synthetic DNA
ttaatcgaaacactattg

SEQ ID NO: 70973 - DNA, 18 bp, Artificial Sequence
  Synthetic DNA
ttaatcgattcgctatag

SEQ ID NO: 70974 - DNA, 18 bp, Artificial Sequence
  Synthetic DNA
ttacacctttcactacag

SEQ ID NO: 70975 - DNA, 18 bp, Artificial Sequence
  Synthetic DNA
ttacacgaaacagttgag

SEQ ID NO: 70976 - DNA, 18 bp, Artificial Sequence
  Synthetic DNA
ttacacgacacgctctag

SEQ ID NO: 70977 - DNA, 18 bp, Artificial Sequence
  Synthetic DNA
ttacacgaccctctagag

SEQ ID NO: 70978 - DNA, 18 bp, Artificial Sequence
  Synthetic DNA
ttacacgtctcactgagg

SEQ ID NO: 70979 - DNA, 18 bp, Artificial Sequence
  Synthetic DNA
ttacatgtctctctatag

SEQ ID NO: 70980 - DNA, 18 bp, Artificial Sequence
  Synthetic DNA
ttaccatactatctatag

SEQ ID NO: 70981 - DNA, 18 bp, Artificial Sequence
  Synthetic DNA
ttactcgcctcacttaag

SEQ ID NO: 70982 - DNA, 18 bp, Artificial Sequence
  Synthetic DNA
ttacttcactcacaattg

SEQ ID NO: 70983 - DNA, 18 bp, Artificial Sequence
  Synthetic DNA
ttacttgactcactatgg

SEQ ID NO: 70984 - DNA, 18 bp, Artificial Sequence
  Synthetic DNA
ttagacctccccctagtg

SEQ ID NO: 70985 - DNA, 18 bp, Artificial Sequence
  Synthetic DNA
ttagacgacgctccatag

SEQ ID NO: 70986 - DNA, 18 bp, Artificial Sequence
  Synthetic DNA
ttagacgattaactattg

SEQ ID NO: 70987 - DNA, 18 bp, Artificial Sequence
  Synthetic DNA
ttagataactaactcaag

SEQ ID NO: 70988 - DNA, 18 bp, Artificial Sequence
  Synthetic DNA
ttataaacctctcaatag

SEQ ID NO: 70989 - DNA, 18 bp, Artificial Sequence
  Synthetic DNA
ttataagactcgcgttag

SEQ ID NO: 70990 - DNA, 18 bp, Artificial Sequence
  Synthetic DNA
ttataaggctcaatgtgg

SEQ ID NO: 70991 - DNA, 18 bp, Artificial Sequence
  Synthetic DNA
ttataattcgcgtgatag

SEQ ID NO: 70992 - DNA, 18 bp, Artificial Sequence
  Synthetic DNA
ttatacaactcacaaatg

SEQ ID NO: 70993 - DNA, 18 bp, Artificial Sequence
  Synthetic DNA
ttatacaactcatgctag

SEQ ID NO: 70994 - DNA, 18 bp, Artificial Sequence
  Synthetic DNA
ttatacatctatctatag

SEQ ID NO: 70995 - DNA, 18 bp, Artificial Sequence
  Synthetic DNA
ttatacatctcattaatg

SEQ ID NO: 70996 - DNA, 18 bp, Artificial Sequence
  Synthetic DNA
ttataccactctttacag

SEQ ID NO: 70997 - DNA, 18 bp, Artificial Sequence
  Synthetic DNA
ttataccacttacaattg

SEQ ID NO: 70998 - DNA, 18 bp, Artificial Sequence
  Synthetic DNA
ttatacgaaacacaatcg

SEQ ID NO: 70999 - DNA, 18 bp, Artificial Sequence
  Synthetic DNA
ttatacgactctattgtg

SEQ ID NO: 71000 - DNA, 18 bp, Artificial Sequence
  Synthetic DNA
ttatacgactcttaatgg

SEQ ID NO: 71001 - DNA, 18 bp, Artificial Sequence
  Synthetic DNA
ttatacgactggcttaag

SEQ ID NO: 71002 - DNA, 18 bp, Artificial Sequence
  Synthetic DNA
ttatacgatcatctgaag

SEQ ID NO: 71003 - DNA, 18 bp, Artificial Sequence
  Synthetic DNA
ttatacgattaacgagcg

SEQ ID NO: 71004 - DNA, 18 bp, Artificial Sequence
  Synthetic DNA
ttatacgattaactaagg

SEQ ID NO: 71005 - DNA, 18 bp, Artificial Sequence
  Synthetic DNA
ttatacgatttaccatgg

SEQ ID NO: 71006 - DNA, 18 bp, Artificial Sequence
  Synthetic DNA
ttatacggatgacaatag

SEQ ID NO: 71007 - DNA, 18 bp, Artificial Sequence
  Synthetic DNA
ttatacggttcactaatg

SEQ ID NO: 71008 - DNA, 18 bp, Artificial Sequence
  Synthetic DNA
ttatactaatctcctttg

SEQ ID NO: 71009 - DNA, 18 bp, Artificial Sequence
  Synthetic DNA
ttatactacaatctatag

SEQ ID NO: 71010 - DNA, 18 bp, Artificial Sequence
  Synthetic DNA
ttatactactcgatagag

SEQ ID NO: 71011 - DNA, 18 bp, Artificial Sequence
  Synthetic DNA
ttatactcctcacattag

SEQ ID NO: 71012 - DNA, 18 bp, Artificial Sequence
  Synthetic DNA
ttatactttcctatatag

SEQ ID NO: 71013 - DNA, 18 bp, Artificial Sequence
  Synthetic DNA
ttatagaactctctacag

SEQ ID NO: 71014 - DNA, 18 bp, Artificial Sequence
  Synthetic DNA
ttataggaccttctatag

SEQ ID NO: 71015 - DNA, 18 bp, Artificial Sequence
  Synthetic DNA
ttatatatcccactatag

SEQ ID NO: 71016 - DNA, 18 bp, Artificial Sequence
  Synthetic DNA
ttatatcgctcacagtag

SEQ ID NO: 71017 - DNA, 18 bp, Artificial Sequence
  Synthetic DNA
ttatatgattcacatcag

SEQ ID NO: 71018 - DNA, 18 bp, Artificial Sequence
  Synthetic DNA
ttatatgtctcactagcg

SEQ ID NO: 71019 - DNA, 18 bp, Artificial Sequence
  Synthetic DNA
ttatattattcacaatcg

SEQ ID NO: 71020 - DNA, 18 bp, Artificial Sequence
  Synthetic DNA
ttatcccacttaacatag

SEQ ID NO: 71021 - DNA, 18 bp, Artificial Sequence
  Synthetic DNA
ttatccgaaacaccatgg

SEQ ID NO: 71022 - DNA, 18 bp, Artificial Sequence
  Synthetic DNA
ttatccgacccattttag

SEQ ID NO: 71023 - DNA, 18 bp, Artificial Sequence
  Synthetic DNA
ttatccgagatacaatag

SEQ ID NO: 71024 - DNA, 18 bp, Artificial Sequence
  Synthetic DNA
ttatccgtcgcagtattg

SEQ ID NO: 71025 - DNA, 18 bp, Artificial Sequence
  Synthetic DNA
ttatcctactccctcttg

SEQ ID NO: 71026 - DNA, 18 bp, Artificial Sequence
  Synthetic DNA
ttatctgactcactaatg

SEQ ID NO: 71027 - DNA, 18 bp, Artificial Sequence
  Synthetic DNA
ttatgagcctcactaaag

SEQ ID NO: 71028 - DNA, 18 bp, Artificial Sequence
  Synthetic DNA
ttatgaggctcattatag

SEQ ID NO: 71029 - DNA, 18 bp, Artificial Sequence
  Synthetic DNA
ttatgccaatctccatag

SEQ ID NO: 71030 - DNA, 18 bp, Artificial Sequence
  Synthetic DNA
ttatgcgactctcattag

SEQ ID NO: 71031 - DNA, 18 bp, Artificial Sequence
  Synthetic DNA
ttattagacaccctatag

SEQ ID NO: 71032 - DNA, 18 bp, Artificial Sequence
  Synthetic DNA
ttattcatctcactatcg

SEQ ID NO: 71033 - DNA, 18 bp, Artificial Sequence
  Synthetic DNA
ttattccaccgactatag

SEQ ID NO: 71034 - DNA, 18 bp, Artificial Sequence
  Synthetic DNA
ttattcctctcactttag

SEQ ID NO: 71035 - DNA, 18 bp, Artificial Sequence
  Synthetic DNA
ttattcgacacacttaag

SEQ ID NO: 71036 - DNA, 18 bp, Artificial Sequence
  Synthetic DNA
ttattcgacactttttag

SEQ ID NO: 71037 - DNA, 18 bp, Artificial Sequence
  Synthetic DNA
ttattcgatacacattcg

SEQ ID NO: 71038 - DNA, 18 bp, Artificial Sequence
  Synthetic DNA
ttattcgattcgcaaaag

SEQ ID NO: 71039 - DNA, 18 bp, Artificial Sequence
  Synthetic DNA
ttattcgcctaaccattg

SEQ ID NO: 71040 - DNA, 18 bp, Artificial Sequence
  Synthetic DNA
ttattcggcttacttaag

SEQ ID NO: 71041 - DNA, 18 bp, Artificial Sequence
  Synthetic DNA
ttattcttatctctatag

SEQ ID NO: 71042 - DNA, 18 bp, Artificial Sequence
  Synthetic DNA
ttcatcgactcactattg

SEQ ID NO: 71043 - DNA, 18 bp, Artificial Sequence
  Synthetic DNA
ttctacgactctcttttg

SEQ ID NO: 71044 - DNA, 18 bp, Artificial Sequence
  Synthetic DNA
ttctactaatctctatag

SEQ ID NO: 71045 - DNA, 18 bp, Artificial Sequence
  Synthetic DNA
ttgcctgccactcttgag

SEQ ID NO: 71046 - DNA, 18 bp, Artificial Sequence
  Synthetic DNA
ttgtaagatacactatag

SEQ ID NO: 71047 - DNA, 18 bp, Artificial Sequence
  Synthetic DNA
ttgtacttcccactattg

SEQ ID NO: 71048 - DNA, 18 bp, Artificial Sequence
  Synthetic DNA
ttgtccgattcataatag

SEQ ID NO: 71049 - DNA, 18 bp, Artificial Sequence
  Synthetic DNA
ttgtgccattcactaaag

SEQ ID NO: 71050 - DNA, 18 bp, Artificial Sequence
  Synthetic DNA
tttaacgagtgtatatag

SEQ ID NO: 71051 - DNA, 18 bp, Artificial Sequence
  Synthetic DNA
ttttaagacacactaaag

SEQ ID NO: 71052 - DNA, 18 bp, Artificial Sequence
  Synthetic DNA
ttttaagacacactcagg

SEQ ID NO: 71053 - DNA, 18 bp, Artificial Sequence
  Synthetic DNA
ttttacatatcaccattg

SEQ ID NO: 71054 - DNA, 18 bp, Artificial Sequence
  Synthetic DNA
ttttacgacactctaaag

SEQ ID NO: 71055 - DNA, 18 bp, Artificial Sequence
  Synthetic DNA
ttttacgacagtctacgg

SEQ ID NO: 71056 - DNA, 18 bp, Artificial Sequence
  Synthetic DNA
ttttacgcacccctaaag

SEQ ID NO: 71057 - DNA, 18 bp, Artificial Sequence
  Synthetic DNA
ttttacgtctcacaaaag

SEQ ID NO: 71058 - DNA, 18 bp, Artificial Sequence
  Synthetic DNA
ttttacgtctcactactg

SEQ ID NO: 71059 - DNA, 18 bp, Artificial Sequence
  Synthetic DNA
ttttacgtctctctttag

SEQ ID NO: 71060 - DNA, 18 bp, Artificial Sequence
  Synthetic DNA
ttttactactctttatag

SEQ ID NO: 71061 - DNA, 18 bp, Artificial Sequence
  Synthetic DNA
ttttgcggctcaccatag

SEQ ID NO: 71062 - DNA, 18 bp, Artificial Sequence
  Synthetic DNA
tttttcgactaactttag

SEQ ID NO: 71063 - DNA, 18 bp, Artificial Sequence
  Synthetic DNA
aaaaacgactcacttatg

SEQ ID NO: 71064 - DNA, 18 bp, Artificial Sequence
  Synthetic DNA
aattataactcactttag

SEQ ID NO: 71065 - DNA, 18 bp, Artificial Sequence
  Synthetic DNA
taatatgacactctaatg

SEQ ID NO: 71066 - DNA, 18 bp, Artificial Sequence
  Synthetic DNA
tattactacaagctatag

SEQ ID NO: 71067 - DNA, 18 bp, Artificial Sequence
  Synthetic DNA
tatttcatctcactttag

SEQ ID NO: 71068 - DNA, 18 bp, Artificial Sequence
  Synthetic DNA
ttaatcgactctcaatag

SEQ ID NO: 71069 - DNA, 18 bp, Artificial Sequence
  Synthetic DNA
ttataagacacactaatg

SEQ ID NO: 71070 - DNA, 18 bp, Artificial Sequence
  Synthetic DNA
ttatgcgattcacttttg

SEQ ID NO: 71071 - DNA, 18 bp, Artificial Sequence
  Synthetic DNA
ttattagtcacactatag

SEQ ID NO: 71072 - DNA, 18 bp, Artificial Sequence
  Synthetic DNA
ttttacgactcacatttg

SEQ ID NO: 71073 - DNA, 18 bp, Artificial Sequence
  Synthetic DNA
tagtacgtatcaccaagg

SEQ ID NO: 71074 - DNA, 18 bp, Artificial Sequence
  Synthetic DNA
ataatcgtctcactatag

SEQ ID NO: 71075 - DNA, 18 bp, Artificial Sequence
  Synthetic DNA
atatacgactctcaaaag

SEQ ID NO: 71076 - DNA, 18 bp, Artificial Sequence
  Synthetic DNA
taaaacgacacactcatg

SEQ ID NO: 71077 - DNA, 18 bp, Artificial Sequence
  Synthetic DNA
tagaacttcttactatag

SEQ ID NO: 71078 - DNA, 18 bp, Artificial Sequence
  Synthetic DNA
tagtacgacttacttatg

SEQ ID NO: 71079 - DNA, 18 bp, Artificial Sequence
  Synthetic DNA
tataattactcactttag

SEQ ID NO: 71080 - DNA, 18 bp, Artificial Sequence
  Synthetic DNA
ttatacgtatctgtatag

SEQ ID NO: 71081 - DNA, 18 bp, Artificial Sequence
  Synthetic DNA
ttatacttctctatatag

SEQ ID NO: 71082 - DNA, 18 bp, Artificial Sequence
  Synthetic DNA
ttattcgactctcttaag

SEQ ID NO: 71083 - DNA, 18 bp, Artificial Sequence
  Synthetic DNA
aaaatcatcattcactag

SEQ ID NO: 71084 - DNA, 18 bp, Artificial Sequence
  Synthetic DNA
aaacacgattgactttag

SEQ ID NO: 71085 - DNA, 18 bp, Artificial Sequence
  Synthetic DNA
aaacatgactcagtgttg

SEQ ID NO: 71086 - DNA, 18 bp, Artificial Sequence
  Synthetic DNA
aaagacgacaccctattg

SEQ ID NO: 71087 - DNA, 18 bp, Artificial Sequence
  Synthetic DNA
aaataactccatctatag

SEQ ID NO: 71088 - DNA, 18 bp, Artificial Sequence
  Synthetic DNA
aaataagactcgtaatag

SEQ ID NO: 71089 - DNA, 18 bp, Artificial Sequence
  Synthetic DNA
aaatacaactctctactg

SEQ ID NO: 71090 - DNA, 18 bp, Artificial Sequence
  Synthetic DNA
aaatacaattcattttag

SEQ ID NO: 71091 - DNA, 18 bp, Artificial Sequence
  Synthetic DNA
aaatacatcacattatag

SEQ ID NO: 71092 - DNA, 18 bp, Artificial Sequence
  Synthetic DNA
aaatacatctcaagatag

SEQ ID NO: 71093 - DNA, 18 bp, Artificial Sequence
  Synthetic DNA
aaataccaatcgcgatag

SEQ ID NO: 71094 - DNA, 18 bp, Artificial Sequence
  Synthetic DNA
aaatacgactttcttgag

SEQ ID NO: 71095 - DNA, 18 bp, Artificial Sequence
  Synthetic DNA
aaatacgagtcccaaagg

SEQ ID NO: 71096 - DNA, 18 bp, Artificial Sequence
  Synthetic DNA
aaatacggctcacactcg

SEQ ID NO: 71097 - DNA, 18 bp, Artificial Sequence
  Synthetic DNA
aaatacgtaatactatag

SEQ ID NO: 71098 - DNA, 18 bp, Artificial Sequence
  Synthetic DNA
aaatacgtcccacaattg

SEQ ID NO: 71099 - DNA, 18 bp, Artificial Sequence
  Synthetic DNA
aaatacttctaactaaag

SEQ ID NO: 71100 - DNA, 18 bp, Artificial Sequence
  Synthetic DNA
aaatacttctcaatattg

SEQ ID NO: 71101 - DNA, 18 bp, Artificial Sequence
  Synthetic DNA
aaatacttctgatcatag

SEQ ID NO: 71102 - DNA, 18 bp, Artificial Sequence
  Synthetic DNA
aaatataactcactccag

SEQ ID NO: 71103 - DNA, 18 bp, Artificial Sequence
  Synthetic DNA
aaatatgtatcacaatag

SEQ ID NO: 71104 - DNA, 18 bp, Artificial Sequence
  Synthetic DNA
aaatctgcctcatcaatg

SEQ ID NO: 71105 - DNA, 18 bp, Artificial Sequence
  Synthetic DNA
aaatgccacacacttaag

SEQ ID NO: 71106 - DNA, 18 bp, Artificial Sequence
  Synthetic DNA
aaattcaaccctctattg

SEQ ID NO: 71107 - DNA, 18 bp, Artificial Sequence
  Synthetic DNA
aaattgtactcatagtag

SEQ ID NO: 71108 - DNA, 18 bp, Artificial Sequence
  Synthetic DNA
aacatctacacattctag

SEQ ID NO: 71109 - DNA, 18 bp, Artificial Sequence
  Synthetic DNA
aaccacgtcacactatag

SEQ ID NO: 71110 - DNA, 18 bp, Artificial Sequence
  Synthetic DNA
aactacgactcaccaatg

SEQ ID NO: 71111 - DNA, 18 bp, Artificial Sequence
  Synthetic DNA
aactacgtatctcgatag

SEQ ID NO: 71112 - DNA, 18 bp, Artificial Sequence
  Synthetic DNA
aagcacgactcagtctag

SEQ ID NO: 71113 - DNA, 18 bp, Artificial Sequence
  Synthetic DNA
aataacaactcacgttag

SEQ ID NO: 71114 - DNA, 18 bp, Artificial Sequence
  Synthetic DNA
aatatcgattcacgatag

SEQ ID NO: 71115 - DNA, 18 bp, Artificial Sequence
  Synthetic DNA
aatcatgagtctctatag

SEQ ID NO: 71116 - DNA, 18 bp, Artificial Sequence
  Synthetic DNA
aatgacgagacactattg

SEQ ID NO: 71117 - DNA, 18 bp, Artificial Sequence
  Synthetic DNA
aattacgacacacttcag

SEQ ID NO: 71118 - DNA, 18 bp, Artificial Sequence
  Synthetic DNA
aattacgattggcgaaag

SEQ ID NO: 71119 - DNA, 18 bp, Artificial Sequence
  Synthetic DNA
aattacgatttactgaag

SEQ ID NO: 71120 - DNA, 18 bp, Artificial Sequence
  Synthetic DNA
aattactattcactttag

SEQ ID NO: 71121 - DNA, 18 bp, Artificial Sequence
  Synthetic DNA
aattactattgactatag

SEQ ID NO: 71122 - DNA, 18 bp, Artificial Sequence
  Synthetic DNA
aattagtactcactaatg

SEQ ID NO: 71123 - DNA, 18 bp, Artificial Sequence
  Synthetic DNA
aatttcgactcacaagag

SEQ ID NO: 71124 - DNA, 18 bp, Artificial Sequence
  Synthetic DNA
aatttcgactctcaaaag

SEQ ID NO: 71125 - DNA, 18 bp, Artificial Sequence
  Synthetic DNA
aatttcgacttactctcg

SEQ ID NO: 71126 - DNA, 18 bp, Artificial Sequence
  Synthetic DNA
acacacaacttactaaag

SEQ ID NO: 71127 - DNA, 18 bp, Artificial Sequence
  Synthetic DNA
acattcgctttactaatg

SEQ ID NO: 71128 - DNA, 18 bp, Artificial Sequence
  Synthetic DNA
agatacttttcaccatag

SEQ ID NO: 71129 - DNA, 18 bp, Artificial Sequence
  Synthetic DNA
agatataactcacttaag

SEQ ID NO: 71130 - DNA, 18 bp, Artificial Sequence
  Synthetic DNA
ataaacaactaactatag

SEQ ID NO: 71131 - DNA, 18 bp, Artificial Sequence
  Synthetic DNA
ataatctactcactatag

SEQ ID NO: 71132 - DNA, 18 bp, Artificial Sequence
  Synthetic DNA
atagactactcacaatag

SEQ ID NO: 71133 - DNA, 18 bp, Artificial Sequence
  Synthetic DNA
atataagactcaataaag

SEQ ID NO: 71134 - DNA, 18 bp, Artificial Sequence
  Synthetic DNA
atatacaactcacttaag

SEQ ID NO: 71135 - DNA, 18 bp, Artificial Sequence
  Synthetic DNA
atatacgaaccactatcg

SEQ ID NO: 71136 - DNA, 18 bp, Artificial Sequence
  Synthetic DNA
atatacgacccactaatg

SEQ ID NO: 71137 - DNA, 18 bp, Artificial Sequence
  Synthetic DNA
atatacgagtctataaag

SEQ ID NO: 71138 - DNA, 18 bp, Artificial Sequence
  Synthetic DNA
atatacgtctcacaaaag

SEQ ID NO: 71139 - DNA, 18 bp, Artificial Sequence
  Synthetic DNA
atatacgttttcctatag

SEQ ID NO: 71140 - DNA, 18 bp, Artificial Sequence
  Synthetic DNA
atatactaatcactattg

SEQ ID NO: 71141 - DNA, 18 bp, Artificial Sequence
  Synthetic DNA
atatatgccacactatgg

SEQ ID NO: 71142 - DNA, 18 bp, Artificial Sequence
  Synthetic DNA
atatgccattctatactg

SEQ ID NO: 71143 - DNA, 18 bp, Artificial Sequence
  Synthetic DNA
atatgcgactgattgatg

SEQ ID NO: 71144 - DNA, 18 bp, Artificial Sequence
  Synthetic DNA
atattcaactgactatag

SEQ ID NO: 71145 - DNA, 18 bp, Artificial Sequence
  Synthetic DNA
atattcgtatcactatag

SEQ ID NO: 71146 - DNA, 18 bp, Artificial Sequence
  Synthetic DNA
attaacgtctgactatag

SEQ ID NO: 71147 - DNA, 18 bp, Artificial Sequence
  Synthetic DNA
atttacgactcaccaaag

SEQ ID NO: 71148 - DNA, 18 bp, Artificial Sequence
  Synthetic DNA
caaaacgcctcactaacg

SEQ ID NO: 71149 - DNA, 18 bp, Artificial Sequence
  Synthetic DNA
caaaactttactcaatag

SEQ ID NO: 71150 - DNA, 18 bp, Artificial Sequence
  Synthetic DNA
caataacaaaccctagag

SEQ ID NO: 71151 - DNA, 18 bp, Artificial Sequence
  Synthetic DNA
caataagactcgccattg

SEQ ID NO: 71152 - DNA, 18 bp, Artificial Sequence
  Synthetic DNA
caatacgacacaccgtgg

SEQ ID NO: 71153 - DNA, 18 bp, Artificial Sequence
  Synthetic DNA
caattcgcctctctttag

SEQ ID NO: 71154 - DNA, 18 bp, Artificial Sequence
  Synthetic DNA
caatttgtcacactatag

SEQ ID NO: 71155 - DNA, 18 bp, Artificial Sequence
  Synthetic DNA
cacatcgaatcacaattg

SEQ ID NO: 71156 - DNA, 18 bp, Artificial Sequence
  Synthetic DNA
caccaactttcactattg

SEQ ID NO: 71157 - DNA, 18 bp, Artificial Sequence
  Synthetic DNA
caccacgagtcactaaag

SEQ ID NO: 71158 - DNA, 18 bp, Artificial Sequence
  Synthetic DNA
catatcgactcactttag

SEQ ID NO: 71159 - DNA, 18 bp, Artificial Sequence
  Synthetic DNA
cattaccacccacgatag

SEQ ID NO: 71160 - DNA, 18 bp, Artificial Sequence
  Synthetic DNA
catttcaactcacgatag

SEQ ID NO: 71161 - DNA, 18 bp, Artificial Sequence
  Synthetic DNA
cggcacgactcactttag

SEQ ID NO: 71162 - DNA, 18 bp, Artificial Sequence
  Synthetic DNA
cgtaacgacttatcatag

SEQ ID NO: 71163 - DNA, 18 bp, Artificial Sequence
  Synthetic DNA
cgtagccacacactatag

SEQ ID NO: 71164 - DNA, 18 bp, Artificial Sequence
  Synthetic DNA
ctaaacgatttactactg

SEQ ID NO: 71165 - DNA, 18 bp, Artificial Sequence
  Synthetic DNA
ctaaactactcactattg

SEQ ID NO: 71166 - DNA, 18 bp, Artificial Sequence
  Synthetic DNA
ctacacgtctcactctag

SEQ ID NO: 71167 - DNA, 18 bp, Artificial Sequence
  Synthetic DNA
ctatacgactccccacag

SEQ ID NO: 71168 - DNA, 18 bp, Artificial Sequence
  Synthetic DNA
ctataggtctcacaatag

SEQ ID NO: 71169 - DNA, 18 bp, Artificial Sequence
  Synthetic DNA
ctatatcactctctatag

SEQ ID NO: 71170 - DNA, 18 bp, Artificial Sequence
  Synthetic DNA
ctatccgactctctttag

SEQ ID NO: 71171 - DNA, 18 bp, Artificial Sequence
  Synthetic DNA
gaacacacctcattatag

SEQ ID NO: 71172 - DNA, 18 bp, Artificial Sequence
  Synthetic DNA
gaatatgatacactatgg

SEQ ID NO: 71173 - DNA, 18 bp, Artificial Sequence
  Synthetic DNA
gaatatgattcacttttg

SEQ ID NO: 71174 - DNA, 18 bp, Artificial Sequence
  Synthetic DNA
gaattcgacagacttcag

SEQ ID NO: 71175 - DNA, 18 bp, Artificial Sequence
  Synthetic DNA
gagtacgaaagacattag

SEQ ID NO: 71176 - DNA, 18 bp, Artificial Sequence
  Synthetic DNA
gataacgacactctatag

SEQ ID NO: 71177 - DNA, 18 bp, Artificial Sequence
  Synthetic DNA
gattaagactcgcaatag

SEQ ID NO: 71178 - DNA, 18 bp, Artificial Sequence
  Synthetic DNA
gatttcaactcactttag

SEQ ID NO: 71179 - DNA, 18 bp, Artificial Sequence
  Synthetic DNA
gtaaccgtcactctattg

SEQ ID NO: 71180 - DNA, 18 bp, Artificial Sequence
  Synthetic DNA
gtatatgattcattaaag

SEQ ID NO: 71181 - DNA, 18 bp, Artificial Sequence
  Synthetic DNA
taaaaagactcacatttg

SEQ ID NO: 71182 - DNA, 18 bp, Artificial Sequence
  Synthetic DNA
taaaaatattcactattg

SEQ ID NO: 71183 - DNA, 18 bp, Artificial Sequence
  Synthetic DNA
taaaacaacactctattg

SEQ ID NO: 71184 - DNA, 18 bp, Artificial Sequence
  Synthetic DNA
taaaacgaatcatttttg

SEQ ID NO: 71185 - DNA, 18 bp, Artificial Sequence
  Synthetic DNA
taaaacgacactacatag

SEQ ID NO: 71186 - DNA, 18 bp, Artificial Sequence
  Synthetic DNA
taaaacgactcgctcatg

SEQ ID NO: 71187 - DNA, 18 bp, Artificial Sequence
  Synthetic DNA
taaaacgagtcacaaatg

SEQ ID NO: 71188 - DNA, 18 bp, Artificial Sequence
  Synthetic DNA
taaaacgattgacaaaag

SEQ ID NO: 71189 - DNA, 18 bp, Artificial Sequence
  Synthetic DNA
taaaacgtatcaatgttg

SEQ ID NO: 71190 - DNA, 18 bp, Artificial Sequence
  Synthetic DNA
taaaactacaatctattg

SEQ ID NO: 71191 - DNA, 18 bp, Artificial Sequence
  Synthetic DNA
taaaactacacccaatag

SEQ ID NO: 71192 - DNA, 18 bp, Artificial Sequence
  Synthetic DNA
taaaagcattctcactcg

SEQ ID NO: 71193 - DNA, 18 bp, Artificial Sequence
  Synthetic DNA
taaaccgactatctttag

SEQ ID NO: 71194 - DNA, 18 bp, Artificial Sequence
  Synthetic DNA
taaaccttctcactaaag

SEQ ID NO: 71195 - DNA, 18 bp, Artificial Sequence
  Synthetic DNA
taaagcgtgtcactatgg

SEQ ID NO: 71196 - DNA, 18 bp, Artificial Sequence
  Synthetic DNA
taaagctattcactaaag

SEQ ID NO: 71197 - DNA, 18 bp, Artificial Sequence
  Synthetic DNA
taaatagtctcactaagg

SEQ ID NO: 71198 - DNA, 18 bp, Artificial Sequence
  Synthetic DNA
taaatccactcacaaatg

SEQ ID NO: 71199 - DNA, 18 bp, Artificial Sequence
  Synthetic DNA
taaatcgactcaaaacag

SEQ ID NO: 71200 - DNA, 18 bp, Artificial Sequence
  Synthetic DNA
taaatcgatatattttag

SEQ ID NO: 71201 - DNA, 18 bp, Artificial Sequence
  Synthetic DNA
taaatcgtcttactacag

SEQ ID NO: 71202 - DNA, 18 bp, Artificial Sequence
  Synthetic DNA
taaatctacatactattg

SEQ ID NO: 71203 - DNA, 18 bp, Artificial Sequence
  Synthetic DNA
taaattgactcacatttg

SEQ ID NO: 71204 - DNA, 18 bp, Artificial Sequence
  Synthetic DNA
taacaactaccataatag

SEQ ID NO: 71205 - DNA, 18 bp, Artificial Sequence
  Synthetic DNA
taacacgatacacttacg

SEQ ID NO: 71206 - DNA, 18 bp, Artificial Sequence
  Synthetic DNA
taacacttctccctatcg

SEQ ID NO: 71207 - DNA, 18 bp, Artificial Sequence
  Synthetic DNA
taacataccattctttag

SEQ ID NO: 71208 - DNA, 18 bp, Artificial Sequence
  Synthetic DNA
taacatgaccttctatgg

SEQ ID NO: 71209 - DNA, 18 bp, Artificial Sequence
  Synthetic DNA
taacatgtcatatcatag

SEQ ID NO: 71210 - DNA, 18 bp, Artificial Sequence
  Synthetic DNA
taaccagacacatcatag

SEQ ID NO: 71211 - DNA, 18 bp, Artificial Sequence
  Synthetic DNA
taactcgactgaacatcg

SEQ ID NO: 71212 - DNA, 18 bp, Artificial Sequence
  Synthetic DNA
taactggtctgactctag

SEQ ID NO: 71213 - DNA, 18 bp, Artificial Sequence
  Synthetic DNA
taagacaatactgtgtgg

SEQ ID NO: 71214 - DNA, 18 bp, Artificial Sequence
  Synthetic DNA
taagataactcgctattg

SEQ ID NO: 71215 - DNA, 18 bp, Artificial Sequence
  Synthetic DNA
taataagaatcattaatg

SEQ ID NO: 71216 - DNA, 18 bp, Artificial Sequence
  Synthetic DNA
taataagacacatttcag

SEQ ID NO: 71217 - DNA, 18 bp, Artificial Sequence
  Synthetic DNA
taataagtctcttttaag

SEQ ID NO: 71218 - DNA, 18 bp, Artificial Sequence
  Synthetic DNA
taataagttttattagag

SEQ ID NO: 71219 - DNA, 18 bp, Artificial Sequence
  Synthetic DNA
taatacaaccaaataaag

SEQ ID NO: 71220 - DNA, 18 bp, Artificial Sequence
  Synthetic DNA
taatacaactcttaaaag

SEQ ID NO: 71221 - DNA, 18 bp, Artificial Sequence
  Synthetic DNA
taatacaagtaactactg

SEQ ID NO: 71222 - DNA, 18 bp, Artificial Sequence
  Synthetic DNA
taatacaccacacaatcg

SEQ ID NO: 71223 - DNA, 18 bp, Artificial Sequence
  Synthetic DNA
taatacatcacacaaaag

SEQ ID NO: 71224 - DNA, 18 bp, Artificial Sequence
  Synthetic DNA
taatacatcttacttttg

SEQ ID NO: 71225 - DNA, 18 bp, Artificial Sequence
  Synthetic DNA
taataccattaattagag

SEQ ID NO: 71226 - DNA, 18 bp, Artificial Sequence
  Synthetic DNA
taataccgctcattactg

SEQ ID NO: 71227 - DNA, 18 bp, Artificial Sequence
  Synthetic DNA
taatacctctcaagctag

SEQ ID NO: 71228 - DNA, 18 bp, Artificial Sequence
  Synthetic DNA
taatacgaaaaatttttg

SEQ ID NO: 71229 - DNA, 18 bp, Artificial Sequence
  Synthetic DNA
taatacgaaaccctaggg

SEQ ID NO: 71230 - DNA, 18 bp, Artificial Sequence
  Synthetic DNA
taatacgaaactttttag

SEQ ID NO: 71231 - DNA, 18 bp, Artificial Sequence
  Synthetic DNA
taatacgaaatacgttag

SEQ ID NO: 71232 - DNA, 18 bp, Artificial Sequence
  Synthetic DNA
taatacgaaatcctagag

SEQ ID NO: 71233 - DNA, 18 bp, Artificial Sequence
  Synthetic DNA
taatacgaatcatattgg

SEQ ID NO: 71234 - DNA, 18 bp, Artificial Sequence
  Synthetic DNA
taatacgacgtgcattag

SEQ ID NO: 71235 - DNA, 18 bp, Artificial Sequence
  Synthetic DNA
taatacgagactccaagg

SEQ ID NO: 71236 - DNA, 18 bp, Artificial Sequence
  Synthetic DNA
taatacgattcaacagtg

SEQ ID NO: 71237 - DNA, 18 bp, Artificial Sequence
  Synthetic DNA
taatacgattcccacttg

SEQ ID NO: 71238 - DNA, 18 bp, Artificial Sequence
  Synthetic DNA
taatacgtcatacaattg

SEQ ID NO: 71239 - DNA, 18 bp, Artificial Sequence
  Synthetic DNA
taatacgtctatcaacag

SEQ ID NO: 71240 - DNA, 18 bp, Artificial Sequence
  Synthetic DNA
taatacgtctatcaatcg

SEQ ID NO: 71241 - DNA, 18 bp, Artificial Sequence
  Synthetic DNA
taatacgtctctcttatg

SEQ ID NO: 71242 - DNA, 18 bp, Artificial Sequence
  Synthetic DNA
taatacgtctgctttaag

SEQ ID NO: 71243 - DNA, 18 bp, Artificial Sequence
  Synthetic DNA
taatacgtgtccatattg

SEQ ID NO: 71244 - DNA, 18 bp, Artificial Sequence
  Synthetic DNA
taatacgtttccctaatg

SEQ ID NO: 71245 - DNA, 18 bp, Artificial Sequence
  Synthetic DNA
taatacgtttctccatgg

SEQ ID NO: 71246 - DNA, 18 bp, Artificial Sequence
  Synthetic DNA
taatactacccgcaatcg

SEQ ID NO: 71247 - DNA, 18 bp, Artificial Sequence
  Synthetic DNA
taatactactttcaaaag

SEQ ID NO: 71248 - DNA, 18 bp, Artificial Sequence
  Synthetic DNA
taatagatcgtacaatag

SEQ ID NO: 71249 - DNA, 18 bp, Artificial Sequence
  Synthetic DNA
taatagcactttttatag

SEQ ID NO: 71250 - DNA, 18 bp, Artificial Sequence
  Synthetic DNA
taataggagtctctgaag

SEQ ID NO: 71251 - DNA, 18 bp, Artificial Sequence
  Synthetic DNA
taataggtatcaatacag

SEQ ID NO: 71252 - DNA, 18 bp, Artificial Sequence
  Synthetic DNA
taataggtttctctattg

SEQ ID NO: 71253 - DNA, 18 bp, Artificial Sequence
  Synthetic DNA
taatataacttaataatg

SEQ ID NO: 71254 - DNA, 18 bp, Artificial Sequence
  Synthetic DNA
taatataattcgctatgg

SEQ ID NO: 71255 - DNA, 18 bp, Artificial Sequence
  Synthetic DNA
taatatgaaactcaatag

SEQ ID NO: 71256 - DNA, 18 bp, Artificial Sequence
  Synthetic DNA
taatatgacaatttctag

SEQ ID NO: 71257 - DNA, 18 bp, Artificial Sequence
  Synthetic DNA
taatatgtctaactaatg

SEQ ID NO: 71258 - DNA, 18 bp, Artificial Sequence
  Synthetic DNA
taatccatcttaattttg

SEQ ID NO: 71259 - DNA, 18 bp, Artificial Sequence
  Synthetic DNA
taatccgaatcacataag

SEQ ID NO: 71260 - DNA, 18 bp, Artificial Sequence
  Synthetic DNA
taatccgacacacatttg

SEQ ID NO: 71261 - DNA, 18 bp, Artificial Sequence
  Synthetic DNA
taatccgactcgatagtg

SEQ ID NO: 71262 - DNA, 18 bp, Artificial Sequence
  Synthetic DNA
taatccgacttaccttcg

SEQ ID NO: 71263 - DNA, 18 bp, Artificial Sequence
  Synthetic DNA
taatcctacacacttaag

SEQ ID NO: 71264 - DNA, 18 bp, Artificial Sequence
  Synthetic DNA
taatccttctctgtatag

SEQ ID NO: 71265 - DNA, 18 bp, Artificial Sequence
  Synthetic DNA
taatcggtcatactatag

SEQ ID NO: 71266 - DNA, 18 bp, Artificial Sequence
  Synthetic DNA
taatgcatctccattttg

SEQ ID NO: 71267 - DNA, 18 bp, Artificial Sequence
  Synthetic DNA
taatgcgtttctatatag

SEQ ID NO: 71268 - DNA, 18 bp, Artificial Sequence
  Synthetic DNA
taatgcgtttctcaatag

SEQ ID NO: 71269 - DNA, 18 bp, Artificial Sequence
  Synthetic DNA
taatgtgtctcattatcg

SEQ ID NO: 71270 - DNA, 18 bp, Artificial Sequence
  Synthetic DNA
taattagactaactccgg

SEQ ID NO: 71271 - DNA, 18 bp, Artificial Sequence
  Synthetic DNA
taattagtctcattttag

SEQ ID NO: 71272 - DNA, 18 bp, Artificial Sequence
  Synthetic DNA
taattcaactcactgctg

SEQ ID NO: 71273 - DNA, 18 bp, Artificial Sequence
  Synthetic DNA
taattcaactcatcttag

SEQ ID NO: 71274 - DNA, 18 bp, Artificial Sequence
  Synthetic DNA
taattcatctcgcattag

SEQ ID NO: 71275 - DNA, 18 bp, Artificial Sequence
  Synthetic DNA
taattccactttctacag

SEQ ID NO: 71276 - DNA, 18 bp, Artificial Sequence
  Synthetic DNA
taattcctatgaatatag

SEQ ID NO: 71277 - DNA, 18 bp, Artificial Sequence
  Synthetic DNA
taattcgaaaccctctag

SEQ ID NO: 71278 - DNA, 18 bp, Artificial Sequence
  Synthetic DNA
taattcgacagaccttag

SEQ ID NO: 71279 - DNA, 18 bp, Artificial Sequence
  Synthetic DNA
taattcgacttaattttg

SEQ ID NO: 71280 - DNA, 18 bp, Artificial Sequence
  Synthetic DNA
taattcgagttccgtaag

SEQ ID NO: 71281 - DNA, 18 bp, Artificial Sequence
  Synthetic DNA
taattcggctcgttgttg

SEQ ID NO: 71282 - DNA, 18 bp, Artificial Sequence
  Synthetic DNA
taattcgtatcactaatg

SEQ ID NO: 71283 - DNA, 18 bp, Artificial Sequence
  Synthetic DNA
taattcgtctcacataag

SEQ ID NO: 71284 - DNA, 18 bp, Artificial Sequence
  Synthetic DNA
taattcgtctcagatctg

SEQ ID NO: 71285 - DNA, 18 bp, Artificial Sequence
  Synthetic DNA
taattcgtctccctaatg

SEQ ID NO: 71286 - DNA, 18 bp, Artificial Sequence
  Synthetic DNA
taattcgtcttactgtgg

SEQ ID NO: 71287 - DNA, 18 bp, Artificial Sequence
  Synthetic DNA
taattcgtttctctttag

SEQ ID NO: 71288 - DNA, 18 bp, Artificial Sequence
  Synthetic DNA
taattcgttttactattg

SEQ ID NO: 71289 - DNA, 18 bp, Artificial Sequence
  Synthetic DNA
taattctacgtgatatag

SEQ ID NO: 71290 - DNA, 18 bp, Artificial Sequence
  Synthetic DNA
taattctactacctttcg

SEQ ID NO: 71291 - DNA, 18 bp, Artificial Sequence
  Synthetic DNA
taattctactcagttaag

SEQ ID NO: 71292 - DNA, 18 bp, Artificial Sequence
  Synthetic DNA
taattcttctcactgaag

SEQ ID NO: 71293 - DNA, 18 bp, Artificial Sequence
  Synthetic DNA
taattggaatttcatttg

SEQ ID NO: 71294 - DNA, 18 bp, Artificial Sequence
  Synthetic DNA
taattggacatacaattg

SEQ ID NO: 71295 - DNA, 18 bp, Artificial Sequence
  Synthetic DNA
taatttaacacactttag

SEQ ID NO: 71296 - DNA, 18 bp, Artificial Sequence
  Synthetic DNA
tacaaaaactctctatag

SEQ ID NO: 71297 - DNA, 18 bp, Artificial Sequence
  Synthetic DNA
tacaacgagtctttatag

SEQ ID NO: 71298 - DNA, 18 bp, Artificial Sequence
  Synthetic DNA
tacaacgtctcactcgtg

SEQ ID NO: 71299 - DNA, 18 bp, Artificial Sequence
  Synthetic DNA
tacaccgacacgttatag

SEQ ID NO: 71300 - DNA, 18 bp, Artificial Sequence
  Synthetic DNA
tactacgactctcttatg

SEQ ID NO: 71301 - DNA, 18 bp, Artificial Sequence
  Synthetic DNA
tactacgtctgtctctcg

SEQ ID NO: 71302 - DNA, 18 bp, Artificial Sequence
  Synthetic DNA
tactacgtcttactacgg

SEQ ID NO: 71303 - DNA, 18 bp, Artificial Sequence
  Synthetic DNA
tacttcgattcaataagg

SEQ ID NO: 71304 - DNA, 18 bp, Artificial Sequence
  Synthetic DNA
tacttcgtctcactaatg

SEQ ID NO: 71305 - DNA, 18 bp, Artificial Sequence
  Synthetic DNA
tacttcgtctgactaacg

SEQ ID NO: 71306 - DNA, 18 bp, Artificial Sequence
  Synthetic DNA
tacttcgtcttataacag

SEQ ID NO: 71307 - DNA, 18 bp, Artificial Sequence
  Synthetic DNA
tagatcgactcagtatcg

SEQ ID NO: 71308 - DNA, 18 bp, Artificial Sequence
  Synthetic DNA
tagatcgtctcgctatag

SEQ ID NO: 71309 - DNA, 18 bp, Artificial Sequence
  Synthetic DNA
tagcacaacgctcagcag

SEQ ID NO: 71310 - DNA, 18 bp, Artificial Sequence
  Synthetic DNA
tagtaagccccaacatag

SEQ ID NO: 71311 - DNA, 18 bp, Artificial Sequence
  Synthetic DNA
tagtacgacacatgctcg

SEQ ID NO: 71312 - DNA, 18 bp, Artificial Sequence
  Synthetic DNA
tagtacgacaccctgtcg

SEQ ID NO: 71313 - DNA, 18 bp, Artificial Sequence
  Synthetic DNA
tagtacgactttatacag

SEQ ID NO: 71314 - DNA, 18 bp, Artificial Sequence
  Synthetic DNA
tagtacggctcaacattg

SEQ ID NO: 71315 - DNA, 18 bp, Artificial Sequence
  Synthetic DNA
tagtacgttacactaaag

SEQ ID NO: 71316 - DNA, 18 bp, Artificial Sequence
  Synthetic DNA
tagtccaatgcactacag

SEQ ID NO: 71317 - DNA, 18 bp, Artificial Sequence
  Synthetic DNA
tagtgctaatcattattg

SEQ ID NO: 71318 - DNA, 18 bp, Artificial Sequence
  Synthetic DNA
tagttcaacttacttaag

SEQ ID NO: 71319 - DNA, 18 bp, Artificial Sequence
  Synthetic DNA
tagttccatcccctctcg

SEQ ID NO: 71320 - DNA, 18 bp, Artificial Sequence
  Synthetic DNA
tataacgacactctttag

SEQ ID NO: 71321 - DNA, 18 bp, Artificial Sequence
  Synthetic DNA
tataacgactaaaaatag

SEQ ID NO: 71322 - DNA, 18 bp, Artificial Sequence
  Synthetic DNA
tataacgactttctctag

SEQ ID NO: 71323 - DNA, 18 bp, Artificial Sequence
  Synthetic DNA
tataacgattcaatttag

SEQ ID NO: 71324 - DNA, 18 bp, Artificial Sequence
  Synthetic DNA
tataacgatttacatcag

SEQ ID NO: 71325 - DNA, 18 bp, Artificial Sequence
  Synthetic DNA
tataactaatcactattg

SEQ ID NO: 71326 - DNA, 18 bp, Artificial Sequence
  Synthetic DNA
tataaggactcacgattg

SEQ ID NO: 71327 - DNA, 18 bp, Artificial Sequence
  Synthetic DNA
tataagggctcactaaag

SEQ ID NO: 71328 - DNA, 18 bp, Artificial Sequence
  Synthetic DNA
tatagcgacttactgtag

SEQ ID NO: 71329 - DNA, 18 bp, Artificial Sequence
  Synthetic DNA
tatagcgactttctatag

SEQ ID NO: 71330 - DNA, 18 bp, Artificial Sequence
  Synthetic DNA
tatagcgtctctctctag

SEQ ID NO: 71331 - DNA, 18 bp, Artificial Sequence
  Synthetic DNA
tatatcaatttactattg

SEQ ID NO: 71332 - DNA, 18 bp, Artificial Sequence
  Synthetic DNA
tatattgactctctatag

SEQ ID NO: 71333 - DNA, 18 bp, Artificial Sequence
  Synthetic DNA
tatcaagactcacaattg

SEQ ID NO: 71334 - DNA, 18 bp, Artificial Sequence
  Synthetic DNA
tatcacaagtaacatcag

SEQ ID NO: 71335 - DNA, 18 bp, Artificial Sequence
  Synthetic DNA
tatcactactctcttaag

SEQ ID NO: 71336 - DNA, 18 bp, Artificial Sequence
  Synthetic DNA
tatcagcattcactatag

SEQ ID NO: 71337 - DNA, 18 bp, Artificial Sequence
  Synthetic DNA
tatcttaacttgctatag

SEQ ID NO: 71338 - DNA, 18 bp, Artificial Sequence
  Synthetic DNA
tatcttgtatctctaaag

SEQ ID NO: 71339 - DNA, 18 bp, Artificial Sequence
  Synthetic DNA
tatgacgactcgcttttg

SEQ ID NO: 71340 - DNA, 18 bp, Artificial Sequence
  Synthetic DNA
tatgtcttctcactcaag

SEQ ID NO: 71341 - DNA, 18 bp, Artificial Sequence
  Synthetic DNA
tattaagacactcaattg

SEQ ID NO: 71342 - DNA, 18 bp, Artificial Sequence
  Synthetic DNA
tattaagtcccattatcg

SEQ ID NO: 71343 - DNA, 18 bp, Artificial Sequence
  Synthetic DNA
tattacaactacgtaaag

SEQ ID NO: 71344 - DNA, 18 bp, Artificial Sequence
  Synthetic DNA
tattacaataatcaattg

SEQ ID NO: 71345 - DNA, 18 bp, Artificial Sequence
  Synthetic DNA
tattacagcgctctatag

SEQ ID NO: 71346 - DNA, 18 bp, Artificial Sequence
  Synthetic DNA
tattacctatcgctacag

SEQ ID NO: 71347 - DNA, 18 bp, Artificial Sequence
  Synthetic DNA
tattacctcattctatgg

SEQ ID NO: 71348 - DNA, 18 bp, Artificial Sequence
  Synthetic DNA
tattacgaaaaaaaattg

SEQ ID NO: 71349 - DNA, 18 bp, Artificial Sequence
  Synthetic DNA
tattacgacactcttttg

SEQ ID NO: 71350 - DNA, 18 bp, Artificial Sequence
  Synthetic DNA
tattacgaccacatatag

SEQ ID NO: 71351 - DNA, 18 bp, Artificial Sequence
  Synthetic DNA
tattacgactttctctcg

SEQ ID NO: 71352 - DNA, 18 bp, Artificial Sequence
  Synthetic DNA
tattacgattctatctag

SEQ ID NO: 71353 - DNA, 18 bp, Artificial Sequence
  Synthetic DNA
tattacggctaacttttg

SEQ ID NO: 71354 - DNA, 18 bp, Artificial Sequence
  Synthetic DNA
tattacgtacacctaaag

SEQ ID NO: 71355 - DNA, 18 bp, Artificial Sequence
  Synthetic DNA
tattacgtcacattattg

SEQ ID NO: 71356 - DNA, 18 bp, Artificial Sequence
  Synthetic DNA
tattacgtctctccaaag

SEQ ID NO: 71357 - DNA, 18 bp, Artificial Sequence
  Synthetic DNA
tattacgtgtcaaaatag

SEQ ID NO: 71358 - DNA, 18 bp, Artificial Sequence
  Synthetic DNA
tattactaccagctatag

SEQ ID NO: 71359 - DNA, 18 bp, Artificial Sequence
  Synthetic DNA
tattacttatcactatcg

SEQ ID NO: 71360 - DNA, 18 bp, Artificial Sequence
  Synthetic DNA
tattacttattaatatag

SEQ ID NO: 71361 - DNA, 18 bp, Artificial Sequence
  Synthetic DNA
tattacttcccactaaag

SEQ ID NO: 71362 - DNA, 18 bp, Artificial Sequence
  Synthetic DNA
tattagtaatttctttag

SEQ ID NO: 71363 - DNA, 18 bp, Artificial Sequence
  Synthetic DNA
tattatatcttactatag

SEQ ID NO: 71364 - DNA, 18 bp, Artificial Sequence
  Synthetic DNA
tattatgaccatatatag

SEQ ID NO: 71365 - DNA, 18 bp, Artificial Sequence
  Synthetic DNA
tattatgatccaccttag

SEQ ID NO: 71366 - DNA, 18 bp, Artificial Sequence
  Synthetic DNA
tattatgtcacactgtag

SEQ ID NO: 71367 - DNA, 18 bp, Artificial Sequence
  Synthetic DNA
tattcagactcacatttg

SEQ ID NO: 71368 - DNA, 18 bp, Artificial Sequence
  Synthetic DNA
tattccgatgcccaatag

SEQ ID NO: 71369 - DNA, 18 bp, Artificial Sequence
  Synthetic DNA
tattccgtctctatatag

SEQ ID NO: 71370 - DNA, 18 bp, Artificial Sequence
  Synthetic DNA
tattgagacgcatgaaag

SEQ ID NO: 71371 - DNA, 18 bp, Artificial Sequence
  Synthetic DNA
tattgttactatcgattg

SEQ ID NO: 71372 - DNA, 18 bp, Artificial Sequence
  Synthetic DNA
tatttcaaatcacactag

SEQ ID NO: 71373 - DNA, 18 bp, Artificial Sequence
  Synthetic DNA
tatttcaaatcactaaag

SEQ ID NO: 71374 - DNA, 18 bp, Artificial Sequence
  Synthetic DNA
tatttcaattccctatag

SEQ ID NO: 71375 - DNA, 18 bp, Artificial Sequence
  Synthetic DNA
tatttcgtatcacgattg

SEQ ID NO: 71376 - DNA, 18 bp, Artificial Sequence
  Synthetic DNA
tatttcgtctcacaatcg

SEQ ID NO: 71377 - DNA, 18 bp, Artificial Sequence
  Synthetic DNA
tatttctacttactaacg

SEQ ID NO: 71378 - DNA, 18 bp, Artificial Sequence
  Synthetic DNA
tattttgtctacattacg

SEQ ID NO: 71379 - DNA, 18 bp, Artificial Sequence
  Synthetic DNA
tcaaacgtttccatatag

SEQ ID NO: 71380 - DNA, 18 bp, Artificial Sequence
  Synthetic DNA
tcaaactaaaaacaatcg

SEQ ID NO: 71381 - DNA, 18 bp, Artificial Sequence
  Synthetic DNA
tcaaactattcactatcg

SEQ ID NO: 71382 - DNA, 18 bp, Artificial Sequence
  Synthetic DNA
tcaatcgactcacaattg

SEQ ID NO: 71383 - DNA, 18 bp, Artificial Sequence
  Synthetic DNA
tcaatctactcactaatg

SEQ ID NO: 71384 - DNA, 18 bp, Artificial Sequence
  Synthetic DNA
tcaatggactcaccatag

SEQ ID NO: 71385 - DNA, 18 bp, Artificial Sequence
  Synthetic DNA
tcatacgacactatttag

SEQ ID NO: 71386 - DNA, 18 bp, Artificial Sequence
  Synthetic DNA
tcatacgacatacttaag

SEQ ID NO: 71387 - DNA, 18 bp, Artificial Sequence
  Synthetic DNA
tcatacgatacattattg

SEQ ID NO: 71388 - DNA, 18 bp, Artificial Sequence
  Synthetic DNA
tcatacgtctccatacag

SEQ ID NO: 71389 - DNA, 18 bp, Artificial Sequence
  Synthetic DNA
tcatccgacactgaagag

SEQ ID NO: 71390 - DNA, 18 bp, Artificial Sequence
  Synthetic DNA
tcatccgacctcatatag

SEQ ID NO: 71391 - DNA, 18 bp, Artificial Sequence
  Synthetic DNA
tcatccgactcaacgtag

SEQ ID NO: 71392 - DNA, 18 bp, Artificial Sequence
  Synthetic DNA
tcatctttcacttattag

SEQ ID NO: 71393 - DNA, 18 bp, Artificial Sequence
  Synthetic DNA
tcatgcgtatcactattg

SEQ ID NO: 71394 - DNA, 18 bp, Artificial Sequence
  Synthetic DNA
tcattagcctagccaaag

SEQ ID NO: 71395 - DNA, 18 bp, Artificial Sequence
  Synthetic DNA
tcattcaacacagtatag

SEQ ID NO: 71396 - DNA, 18 bp, Artificial Sequence
  Synthetic DNA
tcattcgactcaatcttg

SEQ ID NO: 71397 - DNA, 18 bp, Artificial Sequence
  Synthetic DNA
tcattctacccagtacag

SEQ ID NO: 71398 - DNA, 18 bp, Artificial Sequence
  Synthetic DNA
tcatttgacacccattag

SEQ ID NO: 71399 - DNA, 18 bp, Artificial Sequence
  Synthetic DNA
tcatttgactcacgacag

SEQ ID NO: 71400 - DNA, 18 bp, Artificial Sequence
  Synthetic DNA
tccaactactctctaatg

SEQ ID NO: 71401 - DNA, 18 bp, Artificial Sequence
  Synthetic DNA
tcttacgactcgctaccg

SEQ ID NO: 71402 - DNA, 18 bp, Artificial Sequence
  Synthetic DNA
tcttactactctctattg

SEQ ID NO: 71403 - DNA, 18 bp, Artificial Sequence
  Synthetic DNA
tgaaacaacacactaaag

SEQ ID NO: 71404 - DNA, 18 bp, Artificial Sequence
  Synthetic DNA
tgacacgtcacagagtag

SEQ ID NO: 71405 - DNA, 18 bp, Artificial Sequence
  Synthetic DNA
tgataagaatcactaagg

SEQ ID NO: 71406 - DNA, 18 bp, Artificial Sequence
  Synthetic DNA
tgatactccccactttag

SEQ ID NO: 71407 - DNA, 18 bp, Artificial Sequence
  Synthetic DNA
tgattcgtctcaccattg

SEQ ID NO: 71408 - DNA, 18 bp, Artificial Sequence
  Synthetic DNA
tgattctactcattcttg

SEQ ID NO: 71409 - DNA, 18 bp, Artificial Sequence
  Synthetic DNA
tgcttcgactcactcctg

SEQ ID NO: 71410 - DNA, 18 bp, Artificial Sequence
  Synthetic DNA
tggaacgatttggtacag

SEQ ID NO: 71411 - DNA, 18 bp, Artificial Sequence
  Synthetic DNA
tgtaaccacttactatag

SEQ ID NO: 71412 - DNA, 18 bp, Artificial Sequence
  Synthetic DNA
tgtcatgtttccctaaag

SEQ ID NO: 71413 - DNA, 18 bp, Artificial Sequence
  Synthetic DNA
tgttacgtcttactttag

SEQ ID NO: 71414 - DNA, 18 bp, Artificial Sequence
  Synthetic DNA
tgttgagaatctctatag

SEQ ID NO: 71415 - DNA, 18 bp, Artificial Sequence
  Synthetic DNA
ttaaacatctcacaacag

SEQ ID NO: 71416 - DNA, 18 bp, Artificial Sequence
  Synthetic DNA
ttaaacatctcactttag

SEQ ID NO: 71417 - DNA, 18 bp, Artificial Sequence
  Synthetic DNA
ttaaacgagtcacattag

SEQ ID NO: 71418 - DNA, 18 bp, Artificial Sequence
  Synthetic DNA
ttaaacgtttcaatatag

SEQ ID NO: 71419 - DNA, 18 bp, Artificial Sequence
  Synthetic DNA
ttaaagctctctcttgag

SEQ ID NO: 71420 - DNA, 18 bp, Artificial Sequence
  Synthetic DNA
ttaagttcctcactaaag

SEQ ID NO: 71421 - DNA, 18 bp, Artificial Sequence
  Synthetic DNA
ttaatcctctcactatag

SEQ ID NO: 71422 - DNA, 18 bp, Artificial Sequence
  Synthetic DNA
ttaatcgactcactttgg

SEQ ID NO: 71423 - DNA, 18 bp, Artificial Sequence
  Synthetic DNA
ttaatcggctcaccatag

SEQ ID NO: 71424 - DNA, 18 bp, Artificial Sequence
  Synthetic DNA
ttaatctattgactatag

SEQ ID NO: 71425 - DNA, 18 bp, Artificial Sequence
  Synthetic DNA
ttacacgacttacttttg

SEQ ID NO: 71426 - DNA, 18 bp, Artificial Sequence
  Synthetic DNA
ttacattacacacattag

SEQ ID NO: 71427 - DNA, 18 bp, Artificial Sequence
  Synthetic DNA
ttaccggactcagtatag

SEQ ID NO: 71428 - DNA, 18 bp, Artificial Sequence
  Synthetic DNA
ttacgcgactcattaaag

SEQ ID NO: 71429 - DNA, 18 bp, Artificial Sequence
  Synthetic DNA
ttagccgattcgctattg

SEQ ID NO: 71430 - DNA, 18 bp, Artificial Sequence
  Synthetic DNA
ttagtcgtctcacataag

SEQ ID NO: 71431 - DNA, 18 bp, Artificial Sequence
  Synthetic DNA
ttataaaacacactattg

SEQ ID NO: 71432 - DNA, 18 bp, Artificial Sequence
  Synthetic DNA
ttataagacatacatcgg

SEQ ID NO: 71433 - DNA, 18 bp, Artificial Sequence
  Synthetic DNA
ttataatgttctcttttg

SEQ ID NO: 71434 - DNA, 18 bp, Artificial Sequence
  Synthetic DNA
ttatacaaatcacaattg

SEQ ID NO: 71435 - DNA, 18 bp, Artificial Sequence
  Synthetic DNA
ttatacaactaacaaagg

SEQ ID NO: 71436 - DNA, 18 bp, Artificial Sequence
  Synthetic DNA
ttatacatcacattagag

SEQ ID NO: 71437 - DNA, 18 bp, Artificial Sequence
  Synthetic DNA
ttatacatgtcaccatag

SEQ ID NO: 71438 - DNA, 18 bp, Artificial Sequence
  Synthetic DNA
ttataccacatattttag

SEQ ID NO: 71439 - DNA, 18 bp, Artificial Sequence
  Synthetic DNA
ttataccactcacccaag

SEQ ID NO: 71440 - DNA, 18 bp, Artificial Sequence
  Synthetic DNA
ttataccctgcacgatag

SEQ ID NO: 71441 - DNA, 18 bp, Artificial Sequence
  Synthetic DNA
ttatacgaaacatcatag

SEQ ID NO: 71442 - DNA, 18 bp, Artificial Sequence
  Synthetic DNA
ttatacgaacttccttag

SEQ ID NO: 71443 - DNA, 18 bp, Artificial Sequence
  Synthetic DNA
ttatacgaattacaaaag

SEQ ID NO: 71444 - DNA, 18 bp, Artificial Sequence
  Synthetic DNA
ttatacgacaaacataag

SEQ ID NO: 71445 - DNA, 18 bp, Artificial Sequence
  Synthetic DNA
ttatacgacaaaccatcg

SEQ ID NO: 71446 - DNA, 18 bp, Artificial Sequence
  Synthetic DNA
ttatacgtcacgcaatag

SEQ ID NO: 71447 - DNA, 18 bp, Artificial Sequence
  Synthetic DNA
ttatacgtccaacgaaag

SEQ ID NO: 71448 - DNA, 18 bp, Artificial Sequence
  Synthetic DNA
ttatacgtcgctctattg

SEQ ID NO: 71449 - DNA, 18 bp, Artificial Sequence
  Synthetic DNA
ttatacgtctcagcttag

SEQ ID NO: 71450 - DNA, 18 bp, Artificial Sequence
  Synthetic DNA
ttatacgtctctccacag

SEQ ID NO: 71451 - DNA, 18 bp, Artificial Sequence
  Synthetic DNA
ttatacgtctctccagcg

SEQ ID NO: 71452 - DNA, 18 bp, Artificial Sequence
  Synthetic DNA
ttatacgtttaacaatag

SEQ ID NO: 71453 - DNA, 18 bp, Artificial Sequence
  Synthetic DNA
ttatacgtttaactacag

SEQ ID NO: 71454 - DNA, 18 bp, Artificial Sequence
  Synthetic DNA
ttatacgtttctctaaag

SEQ ID NO: 71455 - DNA, 18 bp, Artificial Sequence
  Synthetic DNA
ttatacgtttctctattg

SEQ ID NO: 71456 - DNA, 18 bp, Artificial Sequence
  Synthetic DNA
ttatactactcaacttag

SEQ ID NO: 71457 - DNA, 18 bp, Artificial Sequence
  Synthetic DNA
ttatactattctcaatag

SEQ ID NO: 71458 - DNA, 18 bp, Artificial Sequence
  Synthetic DNA
ttatactgcgagccatag

SEQ ID NO: 71459 - DNA, 18 bp, Artificial Sequence
  Synthetic DNA
ttatagaattcactattg

SEQ ID NO: 71460 - DNA, 18 bp, Artificial Sequence
  Synthetic DNA
ttataggactaacaaatg

SEQ ID NO: 71461 - DNA, 18 bp, Artificial Sequence
  Synthetic DNA
ttataggcttcactaaag

SEQ ID NO: 71462 - DNA, 18 bp, Artificial Sequence
  Synthetic DNA
ttatagggttcgcaacag

SEQ ID NO: 71463 - DNA, 18 bp, Artificial Sequence
  Synthetic DNA
ttataggtatcttcatag

SEQ ID NO: 71464 - DNA, 18 bp, Artificial Sequence
  Synthetic DNA
ttatataactcgatatag

SEQ ID NO: 71465 - DNA, 18 bp, Artificial Sequence
  Synthetic DNA
ttatatgtttcactcttg

SEQ ID NO: 71466 - DNA, 18 bp, Artificial Sequence
  Synthetic DNA
ttatgcgacactctttag

SEQ ID NO: 71467 - DNA, 18 bp, Artificial Sequence
  Synthetic DNA
ttatgcgtttcactatcg

SEQ ID NO: 71468 - DNA, 18 bp, Artificial Sequence
  Synthetic DNA
ttatgtgactcacttgag

SEQ ID NO: 71469 - DNA, 18 bp, Artificial Sequence
  Synthetic DNA
ttatgtgtctcttattag

SEQ ID NO: 71470 - DNA, 18 bp, Artificial Sequence
  Synthetic DNA
ttattagacacacaatag

SEQ ID NO: 71471 - DNA, 18 bp, Artificial Sequence
  Synthetic DNA
ttattagactctctattg

SEQ ID NO: 71472 - DNA, 18 bp, Artificial Sequence
  Synthetic DNA
ttattccactcacaaaag

SEQ ID NO: 71473 - DNA, 18 bp, Artificial Sequence
  Synthetic DNA
ttattcgaaccactttag

SEQ ID NO: 71474 - DNA, 18 bp, Artificial Sequence
  Synthetic DNA
ttattcgacacatttaag

SEQ ID NO: 71475 - DNA, 18 bp, Artificial Sequence
  Synthetic DNA
ttattcgacccgctttag

SEQ ID NO: 71476 - DNA, 18 bp, Artificial Sequence
  Synthetic DNA
ttattcgacttattattg

SEQ ID NO: 71477 - DNA, 18 bp, Artificial Sequence
  Synthetic DNA
ttattctaatcactatcg

SEQ ID NO: 71478 - DNA, 18 bp, Artificial Sequence
  Synthetic DNA
ttattggactgccaattg

SEQ ID NO: 71479 - DNA, 18 bp, Artificial Sequence
  Synthetic DNA
ttcaacgacttataatag

SEQ ID NO: 71480 - DNA, 18 bp, Artificial Sequence
  Synthetic DNA
ttcatcgactttcactag

SEQ ID NO: 71481 - DNA, 18 bp, Artificial Sequence
  Synthetic DNA
ttctacgacatggtattg

SEQ ID NO: 71482 - DNA, 18 bp, Artificial Sequence
  Synthetic DNA
ttctacgattcaattaag

SEQ ID NO: 71483 - DNA, 18 bp, Artificial Sequence
  Synthetic DNA
ttctccgaatcactattg

SEQ ID NO: 71484 - DNA, 18 bp, Artificial Sequence
  Synthetic DNA
ttcttcgactaacaatag

SEQ ID NO: 71485 - DNA, 18 bp, Artificial Sequence
  Synthetic DNA
ttgcacaactccctatag

SEQ ID NO: 71486 - DNA, 18 bp, Artificial Sequence
  Synthetic DNA
ttgtacgaatctttatag

SEQ ID NO: 71487 - DNA, 18 bp, Artificial Sequence
  Synthetic DNA
ttgtacgacttattttag

SEQ ID NO: 71488 - DNA, 18 bp, Artificial Sequence
  Synthetic DNA
ttgtataactctttatag

SEQ ID NO: 71489 - DNA, 18 bp, Artificial Sequence
  Synthetic DNA
ttgttagactaaataccg

SEQ ID NO: 71490 - DNA, 18 bp, Artificial Sequence
  Synthetic DNA
tttaaaatcccactatag

SEQ ID NO: 71491 - DNA, 18 bp, Artificial Sequence
  Synthetic DNA
tttaacaacagactatag

SEQ ID NO: 71492 - DNA, 18 bp, Artificial Sequence
  Synthetic DNA
tttaacaactcactaaag

SEQ ID NO: 71493 - DNA, 18 bp, Artificial Sequence
  Synthetic DNA
tttaacgactcagtatcg

SEQ ID NO: 71494 - DNA, 18 bp, Artificial Sequence
  Synthetic DNA
tttatcgtctcactatag

SEQ ID NO: 71495 - DNA, 18 bp, Artificial Sequence
  Synthetic DNA
tttatcgtgtcacgatag

SEQ ID NO: 71496 - DNA, 18 bp, Artificial Sequence
  Synthetic DNA
tttatgaacttattatag

SEQ ID NO: 71497 - DNA, 18 bp, Artificial Sequence
  Synthetic DNA
ttttacgaaccaccattg

SEQ ID NO: 71498 - DNA, 18 bp, Artificial Sequence
  Synthetic DNA
ttttacgacacgctttag

SEQ ID NO: 71499 - DNA, 18 bp, Artificial Sequence
  Synthetic DNA
ttttacgactcgcttttg

SEQ ID NO: 71500 - DNA, 18 bp, Artificial Sequence
  Synthetic DNA
ttttacgtcttactattg

SEQ ID NO: 71501 - DNA, 18 bp, Artificial Sequence
  Synthetic DNA
ttttactactcattttag

SEQ ID NO: 71502 - DNA, 18 bp, Artificial Sequence
  Synthetic DNA
ttttactactgtctatag

SEQ ID NO: 71503 - DNA, 18 bp, Artificial Sequence
  Synthetic DNA
ttttaggcctcaccacag

SEQ ID NO: 71504 - DNA, 18 bp, Artificial Sequence
  Synthetic DNA
ttttaggtctcacaatag

SEQ ID NO: 71505 - DNA, 18 bp, Artificial Sequence
  Synthetic DNA
ttttatgttttactttag

SEQ ID NO: 71506 - DNA, 18 bp, Artificial Sequence
  Synthetic DNA
tattacctctctctattg

SEQ ID NO: 71507 - DNA, 18 bp, Artificial Sequence
  Synthetic DNA
aataacgtctcactaaag

SEQ ID NO: 71508 - DNA, 18 bp, Artificial Sequence
  Synthetic DNA
taatacaacactcttttg

SEQ ID NO: 71509 - DNA, 18 bp, Artificial Sequence
  Synthetic DNA
tcatacatcacacattag

SEQ ID NO: 71510 - DNA, 18 bp, Artificial Sequence
  Synthetic DNA
ttataggattcaccactg

SEQ ID NO: 71511 - DNA, 18 bp, Artificial Sequence
  Synthetic DNA
taaaacgacaagcaatag

SEQ ID NO: 71512 - DNA, 18 bp, Artificial Sequence
  Synthetic DNA
aagtacggatcactattg

SEQ ID NO: 71513 - DNA, 18 bp, Artificial Sequence
  Synthetic DNA
aattacgtctctctattg

SEQ ID NO: 71514 - DNA, 18 bp, Artificial Sequence
  Synthetic DNA
atatacctcacactatag

SEQ ID NO: 71515 - DNA, 18 bp, Artificial Sequence
  Synthetic DNA
tataacgattcaatacag

SEQ ID NO: 71516 - DNA, 18 bp, Artificial Sequence
  Synthetic DNA
tatcacgactcgcttatg

SEQ ID NO: 71517 - DNA, 18 bp, Artificial Sequence
  Synthetic DNA
aaaaacgacttacattag

SEQ ID NO: 71518 - DNA, 18 bp, Artificial Sequence
  Synthetic DNA
aaaaacgtgtcactattg

SEQ ID NO: 71519 - DNA, 18 bp, Artificial Sequence
  Synthetic DNA
aaaaactactctctttag

SEQ ID NO: 71520 - DNA, 18 bp, Artificial Sequence
  Synthetic DNA
aaaactgactcactattg

SEQ ID NO: 71521 - DNA, 18 bp, Artificial Sequence
  Synthetic DNA
aaaatcgactcactgttg

SEQ ID NO: 71522 - DNA, 18 bp, Artificial Sequence
  Synthetic DNA
aaacacaattgtctatag

SEQ ID NO: 71523 - DNA, 18 bp, Artificial Sequence
  Synthetic DNA
aaacacgtctttctattg

SEQ ID NO: 71524 - DNA, 18 bp, Artificial Sequence
  Synthetic DNA
aaagcagactcactaaag

SEQ ID NO: 71525 - DNA, 18 bp, Artificial Sequence
  Synthetic DNA
aaatacaacactctttag

SEQ ID NO: 71526 - DNA, 18 bp, Artificial Sequence
  Synthetic DNA
aaatacaactctcttaag

SEQ ID NO: 71527 - DNA, 18 bp, Artificial Sequence
  Synthetic DNA
aaatacagcataatattg

SEQ ID NO: 71528 - DNA, 18 bp, Artificial Sequence
  Synthetic DNA
aaatacgaaacaccatcg

SEQ ID NO: 71529 - DNA, 18 bp, Artificial Sequence
  Synthetic DNA
aaatacgacacaataatg

SEQ ID NO: 71530 - DNA, 18 bp, Artificial Sequence
  Synthetic DNA
aaatacgacactaaatag

SEQ ID NO: 71531 - DNA, 18 bp, Artificial Sequence
  Synthetic DNA
aaatacgacagacattag

SEQ ID NO: 71532 - DNA, 18 bp, Artificial Sequence
  Synthetic DNA
aaatacgactaacttatg

SEQ ID NO: 71533 - DNA, 18 bp, Artificial Sequence
  Synthetic DNA
aaatactacacattaaag

SEQ ID NO: 71534 - DNA, 18 bp, Artificial Sequence
  Synthetic DNA
aaatactattctctaaag

SEQ ID NO: 71535 - DNA, 18 bp, Artificial Sequence
  Synthetic DNA
aaatagccttcactatag

SEQ ID NO: 71536 - DNA, 18 bp, Artificial Sequence
  Synthetic DNA
aaattcatctcacattag

SEQ ID NO: 71537 - DNA, 18 bp, Artificial Sequence
  Synthetic DNA
aaattcgccactctatag

SEQ ID NO: 71538 - DNA, 18 bp, Artificial Sequence
  Synthetic DNA
aaattcgtcttacaatag

SEQ ID NO: 71539 - DNA, 18 bp, Artificial Sequence
  Synthetic DNA
aacatcgatacacctttg

SEQ ID NO: 71540 - DNA, 18 bp, Artificial Sequence
  Synthetic DNA
aactacatctcacaattg

SEQ ID NO: 71541 - DNA, 18 bp, Artificial Sequence
  Synthetic DNA
aacttcaactctctatag

SEQ ID NO: 71542 - DNA, 18 bp, Artificial Sequence
  Synthetic DNA
aagcacgtgtctattcag

SEQ ID NO: 71543 - DNA, 18 bp, Artificial Sequence
  Synthetic DNA
aataacgattcggtatcg

SEQ ID NO: 71544 - DNA, 18 bp, Artificial Sequence
  Synthetic DNA
aattaaggctcaatatag

SEQ ID NO: 71545 - DNA, 18 bp, Artificial Sequence
  Synthetic DNA
aattacgacactctattg

SEQ ID NO: 71546 - DNA, 18 bp, Artificial Sequence
  Synthetic DNA
aattacgactcacaaatg

SEQ ID NO: 71547 - DNA, 18 bp, Artificial Sequence
  Synthetic DNA
aattacggctcgatatag

SEQ ID NO: 71548 - DNA, 18 bp, Artificial Sequence
  Synthetic DNA
aattacgtcttactattg

SEQ ID NO: 71549 - DNA, 18 bp, Artificial Sequence
  Synthetic DNA
aattactactcatcatag

SEQ ID NO: 71550 - DNA, 18 bp, Artificial Sequence
  Synthetic DNA
aattactactgacaatag

SEQ ID NO: 71551 - DNA, 18 bp, Artificial Sequence
  Synthetic DNA
aattacttcacaatatag

SEQ ID NO: 71552 - DNA, 18 bp, Artificial Sequence
  Synthetic DNA
acaatggacagactatag

SEQ ID NO: 71553 - DNA, 18 bp, Artificial Sequence
  Synthetic DNA
acactcgtctcactatag

SEQ ID NO: 71554 - DNA, 18 bp, Artificial Sequence
  Synthetic DNA
acatatgtttcactatag

SEQ ID NO: 71555 - DNA, 18 bp, Artificial Sequence
  Synthetic DNA
acatccgactcgctacag

SEQ ID NO: 71556 - DNA, 18 bp, Artificial Sequence
  Synthetic DNA
acattcaactcacaatag

SEQ ID NO: 71557 - DNA, 18 bp, Artificial Sequence
  Synthetic DNA
acttagaactcattttag

SEQ ID NO: 71558 - DNA, 18 bp, Artificial Sequence
  Synthetic DNA
agatacgattttctttag

SEQ ID NO: 71559 - DNA, 18 bp, Artificial Sequence
  Synthetic DNA
agatacgtctcaatattg

SEQ ID NO: 71560 - DNA, 18 bp, Artificial Sequence
  Synthetic DNA
agatgcgacacacattgg

SEQ ID NO: 71561 - DNA, 18 bp, Artificial Sequence
  Synthetic DNA
agatgcgtctatcaaaag

SEQ ID NO: 71562 - DNA, 18 bp, Artificial Sequence
  Synthetic DNA
agattccaccccgatttg

SEQ ID NO: 71563 - DNA, 18 bp, Artificial Sequence
  Synthetic DNA
agttatgactcacttaag

SEQ ID NO: 71564 - DNA, 18 bp, Artificial Sequence
  Synthetic DNA
ataaacgattcattaaag

SEQ ID NO: 71565 - DNA, 18 bp, Artificial Sequence
  Synthetic DNA
atacaagactcactaaag

SEQ ID NO: 71566 - DNA, 18 bp, Artificial Sequence
  Synthetic DNA
atagacaactcactattg

SEQ ID NO: 71567 - DNA, 18 bp, Artificial Sequence
  Synthetic DNA
atagacgtctcaataaag

SEQ ID NO: 71568 - DNA, 18 bp, Artificial Sequence
  Synthetic DNA
atataagacatactatag

SEQ ID NO: 71569 - DNA, 18 bp, Artificial Sequence
  Synthetic DNA
atataagactcacttgag

SEQ ID NO: 71570 - DNA, 18 bp, Artificial Sequence
  Synthetic DNA
atatacacctcattatag

SEQ ID NO: 71571 - DNA, 18 bp, Artificial Sequence
  Synthetic DNA
atataccagtccctatag

SEQ ID NO: 71572 - DNA, 18 bp, Artificial Sequence
  Synthetic DNA
atatacgaatctctaaag

SEQ ID NO: 71573 - DNA, 18 bp, Artificial Sequence
  Synthetic DNA
atatacgattttctatag

SEQ ID NO: 71574 - DNA, 18 bp, Artificial Sequence
  Synthetic DNA
atatccgattaaccatag

SEQ ID NO: 71575 - DNA, 18 bp, Artificial Sequence
  Synthetic DNA
atatgcgaccccttatag

SEQ ID NO: 71576 - DNA, 18 bp, Artificial Sequence
  Synthetic DNA
atatgcgaccctcaatag

SEQ ID NO: 71577 - DNA, 18 bp, Artificial Sequence
  Synthetic DNA
atctacgcctcacaatag

SEQ ID NO: 71578 - DNA, 18 bp, Artificial Sequence
  Synthetic DNA
atgaactactaacaatag

SEQ ID NO: 71579 - DNA, 18 bp, Artificial Sequence
  Synthetic DNA
atgttcgactcactttag

SEQ ID NO: 71580 - DNA, 18 bp, Artificial Sequence
  Synthetic DNA
atgttcgactctctaaag

SEQ ID NO: 71581 - DNA, 18 bp, Artificial Sequence
  Synthetic DNA
attcccgactcacaaatg

SEQ ID NO: 71582 - DNA, 18 bp, Artificial Sequence
  Synthetic DNA
attcccgccactctattg

SEQ ID NO: 71583 - DNA, 18 bp, Artificial Sequence
  Synthetic DNA
atttacgacatacaaaag

SEQ ID NO: 71584 - DNA, 18 bp, Artificial Sequence
  Synthetic DNA
atttacgtctctctatag

SEQ ID NO: 71585 - DNA, 18 bp, Artificial Sequence
  Synthetic DNA
atttccttcacattaaag

SEQ ID NO: 71586 - DNA, 18 bp, Artificial Sequence
  Synthetic DNA
attttcgtttcactctag

SEQ ID NO: 71587 - DNA, 18 bp, Artificial Sequence
  Synthetic DNA
caaaacgactccatattg

SEQ ID NO: 71588 - DNA, 18 bp, Artificial Sequence
  Synthetic DNA
caacaccgtaactttaag

SEQ ID NO: 71589 - DNA, 18 bp, Artificial Sequence
  Synthetic DNA
caactcgtcaaactaatg

SEQ ID NO: 71590 - DNA, 18 bp, Artificial Sequence
  Synthetic DNA
caataccagaaaataaag

SEQ ID NO: 71591 - DNA, 18 bp, Artificial Sequence
  Synthetic DNA
caatacgacactcattag

SEQ ID NO: 71592 - DNA, 18 bp, Artificial Sequence
  Synthetic DNA
caatacgtcactcaatag

SEQ ID NO: 71593 - DNA, 18 bp, Artificial Sequence
  Synthetic DNA
caatgcaacttaccatag

SEQ ID NO: 71594 - DNA, 18 bp, Artificial Sequence
  Synthetic DNA
caattcgtattactatag

SEQ ID NO: 71595 - DNA, 18 bp, Artificial Sequence
  Synthetic DNA
caattcgtcacgctatag

SEQ ID NO: 71596 - DNA, 18 bp, Artificial Sequence
  Synthetic DNA
cacctcgtctcatcaccg

SEQ ID NO: 71597 - DNA, 18 bp, Artificial Sequence
  Synthetic DNA
cactacttctcacaattg

SEQ ID NO: 71598 - DNA, 18 bp, Artificial Sequence
  Synthetic DNA
cattaccactcgcttaag

SEQ ID NO: 71599 - DNA, 18 bp, Artificial Sequence
  Synthetic DNA
cattacgactctccaatg

SEQ ID NO: 71600 - DNA, 18 bp, Artificial Sequence
  Synthetic DNA
cattagggcacactaatg

SEQ ID NO: 71601 - DNA, 18 bp, Artificial Sequence
  Synthetic DNA
cattatgattcacaatag

SEQ ID NO: 71602 - DNA, 18 bp, Artificial Sequence
  Synthetic DNA
catttggatcctctatag

SEQ ID NO: 71603 - DNA, 18 bp, Artificial Sequence
  Synthetic DNA
ccaaaccactcactaaag

SEQ ID NO: 71604 - DNA, 18 bp, Artificial Sequence
  Synthetic DNA
cgatgtgtctcactatag

SEQ ID NO: 71605 - DNA, 18 bp, Artificial Sequence
  Synthetic DNA
ctaacccactcactatag

SEQ ID NO: 71606 - DNA, 18 bp, Artificial Sequence
  Synthetic DNA
ctatacgtaactctatag

SEQ ID NO: 71607 - DNA, 18 bp, Artificial Sequence
  Synthetic DNA
ctatattattcactaaag

SEQ ID NO: 71608 - DNA, 18 bp, Artificial Sequence
  Synthetic DNA
ctatgcgacacactcttg

SEQ ID NO: 71609 - DNA, 18 bp, Artificial Sequence
  Synthetic DNA
ctatgcgtttcactatag

SEQ ID NO: 71610 - DNA, 18 bp, Artificial Sequence
  Synthetic DNA
ctttacaattcacagtag

SEQ ID NO: 71611 - DNA, 18 bp, Artificial Sequence
  Synthetic DNA
gaatacaactcgttattg

SEQ ID NO: 71612 - DNA, 18 bp, Artificial Sequence
  Synthetic DNA
gaatacctctttccatag

SEQ ID NO: 71613 - DNA, 18 bp, Artificial Sequence
  Synthetic DNA
gaatacgcctctcttttg

SEQ ID NO: 71614 - DNA, 18 bp, Artificial Sequence
  Synthetic DNA
gattgcgaatctcttcag

SEQ ID NO: 71615 - DNA, 18 bp, Artificial Sequence
  Synthetic DNA
gatttcgacttactaatg

SEQ ID NO: 71616 - DNA, 18 bp, Artificial Sequence
  Synthetic DNA
gcatactactatcgatag

SEQ ID NO: 71617 - DNA, 18 bp, Artificial Sequence
  Synthetic DNA
gtacaccactcacaatag

SEQ ID NO: 71618 - DNA, 18 bp, Artificial Sequence
  Synthetic DNA
gttttcgaatcacaatag

SEQ ID NO: 71619 - DNA, 18 bp, Artificial Sequence
  Synthetic DNA
taaaaatactcacaagag

SEQ ID NO: 71620 - DNA, 18 bp, Artificial Sequence
  Synthetic DNA
taaaacaacttacaaaag

SEQ ID NO: 71621 - DNA, 18 bp, Artificial Sequence
  Synthetic DNA
taaaacaattcgatatag

SEQ ID NO: 71622 - DNA, 18 bp, Artificial Sequence
  Synthetic DNA
taaaacatcacactatcg

SEQ ID NO: 71623 - DNA, 18 bp, Artificial Sequence
  Synthetic DNA
taaaacatctctctaaag

SEQ ID NO: 71624 - DNA, 18 bp, Artificial Sequence
  Synthetic DNA
taaaaccacactcaatag

SEQ ID NO: 71625 - DNA, 18 bp, Artificial Sequence
  Synthetic DNA
taaaacgaatctgtattg

SEQ ID NO: 71626 - DNA, 18 bp, Artificial Sequence
  Synthetic DNA
taaaacgaatgaccacag

SEQ ID NO: 71627 - DNA, 18 bp, Artificial Sequence
  Synthetic DNA
taaaacgacacaccaatg

SEQ ID NO: 71628 - DNA, 18 bp, Artificial Sequence
  Synthetic DNA
taaaacgacagacaattg

SEQ ID NO: 71629 - DNA, 18 bp, Artificial Sequence
  Synthetic DNA
taaaacgacttacatttg

SEQ ID NO: 71630 - DNA, 18 bp, Artificial Sequence
  Synthetic DNA
taaaacgtcactccatag

SEQ ID NO: 71631 - DNA, 18 bp, Artificial Sequence
  Synthetic DNA
taaaacgtctaacaaaag

SEQ ID NO: 71632 - DNA, 18 bp, Artificial Sequence
  Synthetic DNA
taaaacgtctgaataatg

SEQ ID NO: 71633 - DNA, 18 bp, Artificial Sequence
  Synthetic DNA
taaaactaatcacttgtg

SEQ ID NO: 71634 - DNA, 18 bp, Artificial Sequence
  Synthetic DNA
taaaacttttcactattg

SEQ ID NO: 71635 - DNA, 18 bp, Artificial Sequence
  Synthetic DNA
taaaaggagacaatatag

SEQ ID NO: 71636 - DNA, 18 bp, Artificial Sequence
  Synthetic DNA
taaacagacttactaaag

SEQ ID NO: 71637 - DNA, 18 bp, Artificial Sequence
  Synthetic DNA
taaactgtcacactccag

SEQ ID NO: 71638 - DNA, 18 bp, Artificial Sequence
  Synthetic DNA
taaatcaactctttatag

SEQ ID NO: 71639 - DNA, 18 bp, Artificial Sequence
  Synthetic DNA
taaatcgacaaactaaag

SEQ ID NO: 71640 - DNA, 18 bp, Artificial Sequence
  Synthetic DNA
taaatcgactcacagttg

SEQ ID NO: 71641 - DNA, 18 bp, Artificial Sequence
  Synthetic DNA
taaatcgactcccttttg

SEQ ID NO: 71642 - DNA, 18 bp, Artificial Sequence
  Synthetic DNA
taaatcgtcacacttaag

SEQ ID NO: 71643 - DNA, 18 bp, Artificial Sequence
  Synthetic DNA
taaatcgtgtcactattg

SEQ ID NO: 71644 - DNA, 18 bp, Artificial Sequence
  Synthetic DNA
taacacgacacattaacg

SEQ ID NO: 71645 - DNA, 18 bp, Artificial Sequence
  Synthetic DNA
taacaggactcacatgag

SEQ ID NO: 71646 - DNA, 18 bp, Artificial Sequence
  Synthetic DNA
taagttgtctcaccatag

SEQ ID NO: 71647 - DNA, 18 bp, Artificial Sequence
  Synthetic DNA
taataaggcccacacttg

SEQ ID NO: 71648 - DNA, 18 bp, Artificial Sequence
  Synthetic DNA
taataagtcagtttatag

SEQ ID NO: 71649 - DNA, 18 bp, Artificial Sequence
  Synthetic DNA
taatacaactaccttaag

SEQ ID NO: 71650 - DNA, 18 bp, Artificial Sequence
  Synthetic DNA
taatacaactctcattgg

SEQ ID NO: 71651 - DNA, 18 bp, Artificial Sequence
  Synthetic DNA
taatacaacttacttatg

SEQ ID NO: 71652 - DNA, 18 bp, Artificial Sequence
  Synthetic DNA
taatacaactttacatag

SEQ ID NO: 71653 - DNA, 18 bp, Artificial Sequence
  Synthetic DNA
taatacaagtccatttag

SEQ ID NO: 71654 - DNA, 18 bp, Artificial Sequence
  Synthetic DNA
taatacacctatctagag

SEQ ID NO: 71655 - DNA, 18 bp, Artificial Sequence
  Synthetic DNA
taatacacttctctattg

SEQ ID NO: 71656 - DNA, 18 bp, Artificial Sequence
  Synthetic DNA
taatacatccgactaatg

SEQ ID NO: 71657 - DNA, 18 bp, Artificial Sequence
  Synthetic DNA
taatacatcttagtaaag

SEQ ID NO: 71658 - DNA, 18 bp, Artificial Sequence
  Synthetic DNA
taatacctcgctaaatag

SEQ ID NO: 71659 - DNA, 18 bp, Artificial Sequence
  Synthetic DNA
taatacgaatccttgctg

SEQ ID NO: 71660 - DNA, 18 bp, Artificial Sequence
  Synthetic DNA
taatacgacttaatgatg

SEQ ID NO: 71661 - DNA, 18 bp, Artificial Sequence
  Synthetic DNA
taatacgattttatacag

SEQ ID NO: 71662 - DNA, 18 bp, Artificial Sequence
  Synthetic DNA
taatacgcttgactgcag

SEQ ID NO: 71663 - DNA, 18 bp, Artificial Sequence
  Synthetic DNA
taatacgtccgagtttag

SEQ ID NO: 71664 - DNA, 18 bp, Artificial Sequence
  Synthetic DNA
taatacgtctcataaatg

SEQ ID NO: 71665 - DNA, 18 bp, Artificial Sequence
  Synthetic DNA
taatacgtcttacttacg

SEQ ID NO: 71666 - DNA, 18 bp, Artificial Sequence
  Synthetic DNA
taatacgttacgctattg

SEQ ID NO: 71667 - DNA, 18 bp, Artificial Sequence
  Synthetic DNA
taatacgtttttctattg

SEQ ID NO: 71668 - DNA, 18 bp, Artificial Sequence
  Synthetic DNA
taatactacactatattg

SEQ ID NO: 71669 - DNA, 18 bp, Artificial Sequence
  Synthetic DNA
taatactacttactcacg

SEQ ID NO: 71670 - DNA, 18 bp, Artificial Sequence
  Synthetic DNA
taatacttaacacaatag

SEQ ID NO: 71671 - DNA, 18 bp, Artificial Sequence
  Synthetic DNA
taatacttgtcaatacag

SEQ ID NO: 71672 - DNA, 18 bp, Artificial Sequence
  Synthetic DNA
taatagacctcaccagag

SEQ ID NO: 71673 - DNA, 18 bp, Artificial Sequence
  Synthetic DNA
taataggatttgctattg

SEQ ID NO: 71674 - DNA, 18 bp, Artificial Sequence
  Synthetic DNA
taataggtctctttctag

SEQ ID NO: 71675 - DNA, 18 bp, Artificial Sequence
  Synthetic DNA
taatatgaaactcttttg

SEQ ID NO: 71676 - DNA, 18 bp, Artificial Sequence
  Synthetic DNA
taatatgactccttgaag

SEQ ID NO: 71677 - DNA, 18 bp, Artificial Sequence
  Synthetic DNA
taatatgactcgtcatcg

SEQ ID NO: 71678 - DNA, 18 bp, Artificial Sequence
  Synthetic DNA
taatatgtctatcaattg

SEQ ID NO: 71679 - DNA, 18 bp, Artificial Sequence
  Synthetic DNA
taatattaccctcaatag

SEQ ID NO: 71680 - DNA, 18 bp, Artificial Sequence
  Synthetic DNA
taatccgacaccccttag

SEQ ID NO: 71681 - DNA, 18 bp, Artificial Sequence
  Synthetic DNA
taatccgactcatcaatg

SEQ ID NO: 71682 - DNA, 18 bp, Artificial Sequence
  Synthetic DNA
taatccgtctagctggag

SEQ ID NO: 71683 - DNA, 18 bp, Artificial Sequence
  Synthetic DNA
taatctgattcaaaatag

SEQ ID NO: 71684 - DNA, 18 bp, Artificial Sequence
  Synthetic DNA
taatgcgactagctttcg

SEQ ID NO: 71685 - DNA, 18 bp, Artificial Sequence
  Synthetic DNA
taatgcgactgctttttg

SEQ ID NO: 71686 - DNA, 18 bp, Artificial Sequence
  Synthetic DNA
taatgcgattcaggaaag

SEQ ID NO: 71687 - DNA, 18 bp, Artificial Sequence
  Synthetic DNA
taatgcgcctctcaacag

SEQ ID NO: 71688 - DNA, 18 bp, Artificial Sequence
  Synthetic DNA
taattcaactctctaatg

SEQ ID NO: 71689 - DNA, 18 bp, Artificial Sequence
  Synthetic DNA
taattcgaaccactttcg

SEQ ID NO: 71690 - DNA, 18 bp, Artificial Sequence
  Synthetic DNA
taattcgacactttatgg

SEQ ID NO: 71691 - DNA, 18 bp, Artificial Sequence
  Synthetic DNA
taattcgacgcttattag

SEQ ID NO: 71692 - DNA, 18 bp, Artificial Sequence
  Synthetic DNA
taattcgatgtaatatag

SEQ ID NO: 71693 - DNA, 18 bp, Artificial Sequence
  Synthetic DNA
taattcgtcactctgtag

SEQ ID NO: 71694 - DNA, 18 bp, Artificial Sequence
  Synthetic DNA
taattctcctcacaagag

SEQ ID NO: 71695 - DNA, 18 bp, Artificial Sequence
  Synthetic DNA
taattggacacattgtag

SEQ ID NO: 71696 - DNA, 18 bp, Artificial Sequence
  Synthetic DNA
taatttgtctctctaaag

SEQ ID NO: 71697 - DNA, 18 bp, Artificial Sequence
  Synthetic DNA
taattttacactctatag

SEQ ID NO: 71698 - DNA, 18 bp, Artificial Sequence
  Synthetic DNA
tacatcgccacagtatag

SEQ ID NO: 71699 - DNA, 18 bp, Artificial Sequence
  Synthetic DNA
tactactactcttataag

SEQ ID NO: 71700 - DNA, 18 bp, Artificial Sequence
  Synthetic DNA
tactattacacactttag

SEQ ID NO: 71701 - DNA, 18 bp, Artificial Sequence
  Synthetic DNA
tactccctctctctttag

SEQ ID NO: 71702 - DNA, 18 bp, Artificial Sequence
  Synthetic DNA
tactcctacttcctatag

SEQ ID NO: 71703 - DNA, 18 bp, Artificial Sequence
  Synthetic DNA
tacttaaactcaatatag

SEQ ID NO: 71704 - DNA, 18 bp, Artificial Sequence
  Synthetic DNA
tacttcgacctaccgtag

SEQ ID NO: 71705 - DNA, 18 bp, Artificial Sequence
  Synthetic DNA
tacttcgactctttttag

SEQ ID NO: 71706 - DNA, 18 bp, Artificial Sequence
  Synthetic DNA
tacttctactctctttag

SEQ ID NO: 71707 - DNA, 18 bp, Artificial Sequence
  Synthetic DNA
tagaacaactcaatttag

SEQ ID NO: 71708 - DNA, 18 bp, Artificial Sequence
  Synthetic DNA
tagaaccaatctttacag

SEQ ID NO: 71709 - DNA, 18 bp, Artificial Sequence
  Synthetic DNA
tagaacgtaacactaaag

SEQ ID NO: 71710 - DNA, 18 bp, Artificial Sequence
  Synthetic DNA
tagaacgtcacactttag

SEQ ID NO: 71711 - DNA, 18 bp, Artificial Sequence
  Synthetic DNA
tagaactcctaaattaag

SEQ ID NO: 71712 - DNA, 18 bp, Artificial Sequence
  Synthetic DNA
tagaaggacactctatag

SEQ ID NO: 71713 - DNA, 18 bp, Artificial Sequence
  Synthetic DNA
tagataaactcactattg

SEQ ID NO: 71714 - DNA, 18 bp, Artificial Sequence
  Synthetic DNA
tagcacgtctatctatag

SEQ ID NO: 71715 - DNA, 18 bp, Artificial Sequence
  Synthetic DNA
tagcacgttttacgatag

SEQ ID NO: 71716 - DNA, 18 bp, Artificial Sequence
  Synthetic DNA
tagcataactcactaaag

SEQ ID NO: 71717 - DNA, 18 bp, Artificial Sequence
  Synthetic DNA
tagtacgtcacaccaaag

SEQ ID NO: 71718 - DNA, 18 bp, Artificial Sequence
  Synthetic DNA
tagtcatagttgcaatag

SEQ ID NO: 71719 - DNA, 18 bp, Artificial Sequence
  Synthetic DNA
tagtccgtctcacattag

SEQ ID NO: 71720 - DNA, 18 bp, Artificial Sequence
  Synthetic DNA
tagtgcgactcacttgcg

SEQ ID NO: 71721 - DNA, 18 bp, Artificial Sequence
  Synthetic DNA
tagttctactctccatag

SEQ ID NO: 71722 - DNA, 18 bp, Artificial Sequence
  Synthetic DNA
tataacgattcattattg

SEQ ID NO: 71723 - DNA, 18 bp, Artificial Sequence
  Synthetic DNA
tataactcctcactacag

SEQ ID NO: 71724 - DNA, 18 bp, Artificial Sequence
  Synthetic DNA
tataactgctcaatatag

SEQ ID NO: 71725 - DNA, 18 bp, Artificial Sequence
  Synthetic DNA
tataccgactcaatagtg

SEQ ID NO: 71726 - DNA, 18 bp, Artificial Sequence
  Synthetic DNA
tataccgccacactaaag

SEQ ID NO: 71727 - DNA, 18 bp, Artificial Sequence
  Synthetic DNA
tatagcgactcagtaatg

SEQ ID NO: 71728 - DNA, 18 bp, Artificial Sequence
  Synthetic DNA
tatatagaatcactactg

SEQ ID NO: 71729 - DNA, 18 bp, Artificial Sequence
  Synthetic DNA
tatatccactcaatacag

SEQ ID NO: 71730 - DNA, 18 bp, Artificial Sequence
  Synthetic DNA
tatctcaactcactatgg

SEQ ID NO: 71731 - DNA, 18 bp, Artificial Sequence
  Synthetic DNA
tatgacgactctgttcag

SEQ ID NO: 71732 - DNA, 18 bp, Artificial Sequence
  Synthetic DNA
tattaacactcgctttag

SEQ ID NO: 71733 - DNA, 18 bp, Artificial Sequence
  Synthetic DNA
tattaagacttactactg

SEQ ID NO: 71734 - DNA, 18 bp, Artificial Sequence
  Synthetic DNA
tattaagtcacaatatag

SEQ ID NO: 71735 - DNA, 18 bp, Artificial Sequence
  Synthetic DNA
tattaagtctcaataaag

SEQ ID NO: 71736 - DNA, 18 bp, Artificial Sequence
  Synthetic DNA
tattaagtctctctattg

SEQ ID NO: 71737 - DNA, 18 bp, Artificial Sequence
  Synthetic DNA
tattacaacactccaatg

SEQ ID NO: 71738 - DNA, 18 bp, Artificial Sequence
  Synthetic DNA
tattacaagtttctacag

SEQ ID NO: 71739 - DNA, 18 bp, Artificial Sequence
  Synthetic DNA
tattacacctcattgtag

SEQ ID NO: 71740 - DNA, 18 bp, Artificial Sequence
  Synthetic DNA
tattaccacacaacatag

SEQ ID NO: 71741 - DNA, 18 bp, Artificial Sequence
  Synthetic DNA
tattaccattcaccaaag

SEQ ID NO: 71742 - DNA, 18 bp, Artificial Sequence
  Synthetic DNA
tattacgactcacacatg

SEQ ID NO: 71743 - DNA, 18 bp, Artificial Sequence
  Synthetic DNA
tattacgactcgattttg

SEQ ID NO: 71744 - DNA, 18 bp, Artificial Sequence
  Synthetic DNA
tattacgagacgttaaag

SEQ ID NO: 71745 - DNA, 18 bp, Artificial Sequence
  Synthetic DNA
tattacgtaactctatag

SEQ ID NO: 71746 - DNA, 18 bp, Artificial Sequence
  Synthetic DNA
tattacgtcactatatag

SEQ ID NO: 71747 - DNA, 18 bp, Artificial Sequence
  Synthetic DNA
tattacgtctatgtatag

SEQ ID NO: 71748 - DNA, 18 bp, Artificial Sequence
  Synthetic DNA
tattacgtttctctttag

SEQ ID NO: 71749 - DNA, 18 bp, Artificial Sequence
  Synthetic DNA
tattactacgaaaaatag

SEQ ID NO: 71750 - DNA, 18 bp, Artificial Sequence
  Synthetic DNA
tattactcgtctctatgg

SEQ ID NO: 71751 - DNA, 18 bp, Artificial Sequence
  Synthetic DNA
tattacttcacactaaag

SEQ ID NO: 71752 - DNA, 18 bp, Artificial Sequence
  Synthetic DNA
tattatcacactcaatag

SEQ ID NO: 71753 - DNA, 18 bp, Artificial Sequence
  Synthetic DNA
tattatgactttttatag

SEQ ID NO: 71754 - DNA, 18 bp, Artificial Sequence
  Synthetic DNA
tattatgatacactttag

SEQ ID NO: 71755 - DNA, 18 bp, Artificial Sequence
  Synthetic DNA
tattcagactctctttag

SEQ ID NO: 71756 - DNA, 18 bp, Artificial Sequence
  Synthetic DNA
tattccgactcacgtttg

SEQ ID NO: 71757 - DNA, 18 bp, Artificial Sequence
  Synthetic DNA
tattccttctctaaattg

SEQ ID NO: 71758 - DNA, 18 bp, Artificial Sequence
  Synthetic DNA
tattgcgactctctactg

SEQ ID NO: 71759 - DNA, 18 bp, Artificial Sequence
  Synthetic DNA
tatttagactctctttag

SEQ ID NO: 71760 - DNA, 18 bp, Artificial Sequence
  Synthetic DNA
tatttagtcttactagtg

SEQ ID NO: 71761 - DNA, 18 bp, Artificial Sequence
  Synthetic DNA
tatttcaaatcactcttg

SEQ ID NO: 71762 - DNA, 18 bp, Artificial Sequence
  Synthetic DNA
tatttcgaaacgcataag

SEQ ID NO: 71763 - DNA, 18 bp, Artificial Sequence
  Synthetic DNA
tatttcgacccattttag

SEQ ID NO: 71764 - DNA, 18 bp, Artificial Sequence
  Synthetic DNA
tatttcgagtcacaattg

SEQ ID NO: 71765 - DNA, 18 bp, Artificial Sequence
  Synthetic DNA
tatttcgattgacaaaag

SEQ ID NO: 71766 - DNA, 18 bp, Artificial Sequence
  Synthetic DNA
tatttctactcaacatag

SEQ ID NO: 71767 - DNA, 18 bp, Artificial Sequence
  Synthetic DNA
tatttctagtcacaaaag

SEQ ID NO: 71768 - DNA, 18 bp, Artificial Sequence
  Synthetic DNA
tattttgacactccatag

SEQ ID NO: 71769 - DNA, 18 bp, Artificial Sequence
  Synthetic DNA
tcaatcgcctcaccatag

SEQ ID NO: 71770 - DNA, 18 bp, Artificial Sequence
  Synthetic DNA
tcataataacctgtattg

SEQ ID NO: 71771 - DNA, 18 bp, Artificial Sequence
  Synthetic DNA
tcatacgaattacattag

SEQ ID NO: 71772 - DNA, 18 bp, Artificial Sequence
  Synthetic DNA
tcatacgacagacattag

SEQ ID NO: 71773 - DNA, 18 bp, Artificial Sequence
  Synthetic DNA
tcatacgtctctcataag

SEQ ID NO: 71774 - DNA, 18 bp, Artificial Sequence
  Synthetic DNA
tcatactactaccaatag

SEQ ID NO: 71775 - DNA, 18 bp, Artificial Sequence
  Synthetic DNA
tcatacttcgcactacag

SEQ ID NO: 71776 - DNA, 18 bp, Artificial Sequence
  Synthetic DNA
tcatagcacacactaatg

SEQ ID NO: 71777 - DNA, 18 bp, Artificial Sequence
  Synthetic DNA
tcatatgattcaccctag

SEQ ID NO: 71778 - DNA, 18 bp, Artificial Sequence
  Synthetic DNA
tcatccttctccctttag

SEQ ID NO: 71779 - DNA, 18 bp, Artificial Sequence
  Synthetic DNA
tcattcagcacactatag

SEQ ID NO: 71780 - DNA, 18 bp, Artificial Sequence
  Synthetic DNA
tcattcgactaactactg

SEQ ID NO: 71781 - DNA, 18 bp, Artificial Sequence
  Synthetic DNA
tcattgtactcactattg

SEQ ID NO: 71782 - DNA, 18 bp, Artificial Sequence
  Synthetic DNA
tcctaatactcacaattg

SEQ ID NO: 71783 - DNA, 18 bp, Artificial Sequence
  Synthetic DNA
tcctacgaatgtctatag

SEQ ID NO: 71784 - DNA, 18 bp, Artificial Sequence
  Synthetic DNA
tcctccgactctctttag

SEQ ID NO: 71785 - DNA, 18 bp, Artificial Sequence
  Synthetic DNA
tcgtgcgactgacaattg

SEQ ID NO: 71786 - DNA, 18 bp, Artificial Sequence
  Synthetic DNA
tcttaccgctcactaaag

SEQ ID NO: 71787 - DNA, 18 bp, Artificial Sequence
  Synthetic DNA
tcttaggactcacaacag

SEQ ID NO: 71788 - DNA, 18 bp, Artificial Sequence
  Synthetic DNA
tgaaacgaaagactgtag

SEQ ID NO: 71789 - DNA, 18 bp, Artificial Sequence
  Synthetic DNA
tgaaacgaacgactatag

SEQ ID NO: 71790 - DNA, 18 bp, Artificial Sequence
  Synthetic DNA
tgaaacgacacagtattg

SEQ ID NO: 71791 - DNA, 18 bp, Artificial Sequence
  Synthetic DNA
tgataagacactcttttg

SEQ ID NO: 71792 - DNA, 18 bp, Artificial Sequence
  Synthetic DNA
tgataagagacacaaagg

SEQ ID NO: 71793 - DNA, 18 bp, Artificial Sequence
  Synthetic DNA
tgataagcctcacaattg

SEQ ID NO: 71794 - DNA, 18 bp, Artificial Sequence
  Synthetic DNA
tgatacaactaagtttag

SEQ ID NO: 71795 - DNA, 18 bp, Artificial Sequence
  Synthetic DNA
tgataccaatctctattg

SEQ ID NO: 71796 - DNA, 18 bp, Artificial Sequence
  Synthetic DNA
tgatacgacatattttgg

SEQ ID NO: 71797 - DNA, 18 bp, Artificial Sequence
  Synthetic DNA
tgatacgtctgccaatag

SEQ ID NO: 71798 - DNA, 18 bp, Artificial Sequence
  Synthetic DNA
tgatactactctcttatg

SEQ ID NO: 71799 - DNA, 18 bp, Artificial Sequence
  Synthetic DNA
tgatatgtcactttgtag

SEQ ID NO: 71800 - DNA, 18 bp, Artificial Sequence
  Synthetic DNA
tgatgcgaaccactattg

SEQ ID NO: 71801 - DNA, 18 bp, Artificial Sequence
  Synthetic DNA
tgatgcgattcactaatg

SEQ ID NO: 71802 - DNA, 18 bp, Artificial Sequence
  Synthetic DNA
tgattccacacactaaag

SEQ ID NO: 71803 - DNA, 18 bp, Artificial Sequence
  Synthetic DNA
tgatttgactcacatttg

SEQ ID NO: 71804 - DNA, 18 bp, Artificial Sequence
  Synthetic DNA
tgctacgattctttgtag

SEQ ID NO: 71805 - DNA, 18 bp, Artificial Sequence
  Synthetic DNA
tgttaagactcaccaggg

SEQ ID NO: 71806 - DNA, 18 bp, Artificial Sequence
  Synthetic DNA
ttaaacagctcactttag

SEQ ID NO: 71807 - DNA, 18 bp, Artificial Sequence
  Synthetic DNA
ttaaacgaccctccatag

SEQ ID NO: 71808 - DNA, 18 bp, Artificial Sequence
  Synthetic DNA
ttaaacgacttcctattg

SEQ ID NO: 71809 - DNA, 18 bp, Artificial Sequence
  Synthetic DNA
ttaaacgatttattttag

SEQ ID NO: 71810 - DNA, 18 bp, Artificial Sequence
  Synthetic DNA
ttaaacgcctctcaaaag

SEQ ID NO: 71811 - DNA, 18 bp, Artificial Sequence
  Synthetic DNA
ttaaacgtctcactactg

SEQ ID NO: 71812 - DNA, 18 bp, Artificial Sequence
  Synthetic DNA
ttaaactacccactattg

SEQ ID NO: 71813 - DNA, 18 bp, Artificial Sequence
  Synthetic DNA
ttaaatgactcattttag

SEQ ID NO: 71814 - DNA, 18 bp, Artificial Sequence
  Synthetic DNA
ttaaatgattcactttag

SEQ ID NO: 71815 - DNA, 18 bp, Artificial Sequence
  Synthetic DNA
ttaagcgactcaaaatag

SEQ ID NO: 71816 - DNA, 18 bp, Artificial Sequence
  Synthetic DNA
ttacaagaatcacattag

SEQ ID NO: 71817 - DNA, 18 bp, Artificial Sequence
  Synthetic DNA
ttacacgacttactccag

SEQ ID NO: 71818 - DNA, 18 bp, Artificial Sequence
  Synthetic DNA
ttacacgtcacattatag

SEQ ID NO: 71819 - DNA, 18 bp, Artificial Sequence
  Synthetic DNA
ttacacgtctcacaattg

SEQ ID NO: 71820 - DNA, 18 bp, Artificial Sequence
  Synthetic DNA
ttacactactcactcttg

SEQ ID NO: 71821 - DNA, 18 bp, Artificial Sequence
  Synthetic DNA
ttacataattccctttgg

SEQ ID NO: 71822 - DNA, 18 bp, Artificial Sequence
  Synthetic DNA
ttacttgaatcacgctag

SEQ ID NO: 71823 - DNA, 18 bp, Artificial Sequence
  Synthetic DNA
ttagtagactttcaatag

SEQ ID NO: 71824 - DNA, 18 bp, Artificial Sequence
  Synthetic DNA
ttataaaaatcagcaaag

SEQ ID NO: 71825 - DNA, 18 bp, Artificial Sequence
  Synthetic DNA
ttatacaactcacataag

SEQ ID NO: 71826 - DNA, 18 bp, Artificial Sequence
  Synthetic DNA
ttataccacacactaatg

SEQ ID NO: 71827 - DNA, 18 bp, Artificial Sequence
  Synthetic DNA
ttatacctcacactagag

SEQ ID NO: 71828 - DNA, 18 bp, Artificial Sequence
  Synthetic DNA
ttatacgaaacaataatg

SEQ ID NO: 71829 - DNA, 18 bp, Artificial Sequence
  Synthetic DNA
ttatacgaccctatattg

SEQ ID NO: 71830 - DNA, 18 bp, Artificial Sequence
  Synthetic DNA
ttatacgagatactatgg

SEQ ID NO: 71831 - DNA, 18 bp, Artificial Sequence
  Synthetic DNA
ttatacgattaacttctg

SEQ ID NO: 71832 - DNA, 18 bp, Artificial Sequence
  Synthetic DNA
ttatacgccattctatag

SEQ ID NO: 71833 - DNA, 18 bp, Artificial Sequence
  Synthetic DNA
ttatacgcttgactcaag

SEQ ID NO: 71834 - DNA, 18 bp, Artificial Sequence
  Synthetic DNA
ttatacgtcacacttaag

SEQ ID NO: 71835 - DNA, 18 bp, Artificial Sequence
  Synthetic DNA
ttatacgtcacgccacag

SEQ ID NO: 71836 - DNA, 18 bp, Artificial Sequence
  Synthetic DNA
ttatacgtctcgcttttg

SEQ ID NO: 71837 - DNA, 18 bp, Artificial Sequence
  Synthetic DNA
ttatacgtctttcaatag

SEQ ID NO: 71838 - DNA, 18 bp, Artificial Sequence
  Synthetic DNA
ttatacgtttaacattag

SEQ ID NO: 71839 - DNA, 18 bp, Artificial Sequence
  Synthetic DNA
ttatactacacacattag

SEQ ID NO: 71840 - DNA, 18 bp, Artificial Sequence
  Synthetic DNA
ttatacttctcacaattg

SEQ ID NO: 71841 - DNA, 18 bp, Artificial Sequence
  Synthetic DNA
ttatagaattcaccatag

SEQ ID NO: 71842 - DNA, 18 bp, Artificial Sequence
  Synthetic DNA
ttatatgtcccactatcg

SEQ ID NO: 71843 - DNA, 18 bp, Artificial Sequence
  Synthetic DNA
ttatccgatcaactatag

SEQ ID NO: 71844 - DNA, 18 bp, Artificial Sequence
  Synthetic DNA
ttatccgattctctttag

SEQ ID NO: 71845 - DNA, 18 bp, Artificial Sequence
  Synthetic DNA
ttatcctactcaaaatag

SEQ ID NO: 71846 - DNA, 18 bp, Artificial Sequence
  Synthetic DNA
ttatgcgacacattaaag

SEQ ID NO: 71847 - DNA, 18 bp, Artificial Sequence
  Synthetic DNA
ttattaaactcaccatag

SEQ ID NO: 71848 - DNA, 18 bp, Artificial Sequence
  Synthetic DNA
ttattagacccactttag

SEQ ID NO: 71849 - DNA, 18 bp, Artificial Sequence
  Synthetic DNA
ttattccatcatctgtag

SEQ ID NO: 71850 - DNA, 18 bp, Artificial Sequence
  Synthetic DNA
ttattcgacaaactctag

SEQ ID NO: 71851 - DNA, 18 bp, Artificial Sequence
  Synthetic DNA
ttattcgacttacaatgg

SEQ ID NO: 71852 - DNA, 18 bp, Artificial Sequence
  Synthetic DNA
ttattcgatacactacag

SEQ ID NO: 71853 - DNA, 18 bp, Artificial Sequence
  Synthetic DNA
ttattcgattcactcttg

SEQ ID NO: 71854 - DNA, 18 bp, Artificial Sequence
  Synthetic DNA
ttattcgcctcacaaaag

SEQ ID NO: 71855 - DNA, 18 bp, Artificial Sequence
  Synthetic DNA
ttattcgcctcactgaag

SEQ ID NO: 71856 - DNA, 18 bp, Artificial Sequence
  Synthetic DNA
ttattctactcacttaag

SEQ ID NO: 71857 - DNA, 18 bp, Artificial Sequence
  Synthetic DNA
ttattctactctctagag

SEQ ID NO: 71858 - DNA, 18 bp, Artificial Sequence
  Synthetic DNA
ttatttgactctttatag

SEQ ID NO: 71859 - DNA, 18 bp, Artificial Sequence
  Synthetic DNA
ttcaacgactctctaaag

SEQ ID NO: 71860 - DNA, 18 bp, Artificial Sequence
  Synthetic DNA
ttcaacgagtcactaaag

SEQ ID NO: 71861 - DNA, 18 bp, Artificial Sequence
  Synthetic DNA
ttccgcaactcagaaaag

SEQ ID NO: 71862 - DNA, 18 bp, Artificial Sequence
  Synthetic DNA
ttctacggttccctatgg

SEQ ID NO: 71863 - DNA, 18 bp, Artificial Sequence
  Synthetic DNA
ttctaggactcagtattg

SEQ ID NO: 71864 - DNA, 18 bp, Artificial Sequence
  Synthetic DNA
ttgtatgttgcactatag

SEQ ID NO: 71865 - DNA, 18 bp, Artificial Sequence
  Synthetic DNA
ttgttcatctctttatag

SEQ ID NO: 71866 - DNA, 18 bp, Artificial Sequence
  Synthetic DNA
tttaaggaccgactatag

SEQ ID NO: 71867 - DNA, 18 bp, Artificial Sequence
  Synthetic DNA
tttagtgactcattaaag

SEQ ID NO: 71868 - DNA, 18 bp, Artificial Sequence
  Synthetic DNA
tttcacgattctcgctag

SEQ ID NO: 71869 - DNA, 18 bp, Artificial Sequence
  Synthetic DNA
ttttacgactctaaatag

SEQ ID NO: 71870 - DNA, 18 bp, Artificial Sequence
  Synthetic DNA
ttttacgccactctattg

SEQ ID NO: 71871 - DNA, 18 bp, Artificial Sequence
  Synthetic DNA
ttttatgacacactaaag

SEQ ID NO: 71872 - DNA, 18 bp, Artificial Sequence
  Synthetic DNA
ttttctgactctctatag

SEQ ID NO: 71873 - DNA, 18 bp, Artificial Sequence
  Synthetic DNA
tttttcgactcaatttag

SEQ ID NO: 71874 - DNA, 18 bp, Artificial Sequence
  Synthetic DNA
aagaacctctcactatag

SEQ ID NO: 71875 - DNA, 18 bp, Artificial Sequence
  Synthetic DNA
taaaacgacactcttttg

SEQ ID NO: 71876 - DNA, 18 bp, Artificial Sequence
  Synthetic DNA
taatacgtcttacatttg

SEQ ID NO: 71877 - DNA, 18 bp, Artificial Sequence
  Synthetic DNA
tataacgactccctcttg

SEQ ID NO: 71878 - DNA, 18 bp, Artificial Sequence
  Synthetic DNA
tatcacgcctcacaattg

SEQ ID NO: 71879 - DNA, 18 bp, Artificial Sequence
  Synthetic DNA
aaaaacgactccctaatg

SEQ ID NO: 71880 - DNA, 18 bp, Artificial Sequence
  Synthetic DNA
aaaaatgactcaccatcg

SEQ ID NO: 71881 - DNA, 18 bp, Artificial Sequence
  Synthetic DNA
aaacacaactcataaaag

SEQ ID NO: 71882 - DNA, 18 bp, Artificial Sequence
  Synthetic DNA
aaacacgactgactccag

SEQ ID NO: 71883 - DNA, 18 bp, Artificial Sequence
  Synthetic DNA
aaaccccacacgctaaag

SEQ ID NO: 71884 - DNA, 18 bp, Artificial Sequence
  Synthetic DNA
aaagacgcctcactctgg

SEQ ID NO: 71885 - DNA, 18 bp, Artificial Sequence
  Synthetic DNA
aaataacactcgctggag

SEQ ID NO: 71886 - DNA, 18 bp, Artificial Sequence
  Synthetic DNA
aaatacaaattactttag

SEQ ID NO: 71887 - DNA, 18 bp, Artificial Sequence
  Synthetic DNA
aaatacaactccctaatg

SEQ ID NO: 71888 - DNA, 18 bp, Artificial Sequence
  Synthetic DNA
aaatacaactctcttttg

SEQ ID NO: 71889 - DNA, 18 bp, Artificial Sequence
  Synthetic DNA
aaatacgactctttgaag

SEQ ID NO: 71890 - DNA, 18 bp, Artificial Sequence
  Synthetic DNA
aaatacgcttatctctag

SEQ ID NO: 71891 - DNA, 18 bp, Artificial Sequence
  Synthetic DNA
aaatagctcccactatag

SEQ ID NO: 71892 - DNA, 18 bp, Artificial Sequence
  Synthetic DNA
aaatatgattcaccttag

SEQ ID NO: 71893 - DNA, 18 bp, Artificial Sequence
  Synthetic DNA
aaatccgtaccactcttg

SEQ ID NO: 71894 - DNA, 18 bp, Artificial Sequence
  Synthetic DNA
aaattcgatacacaatag

SEQ ID NO: 71895 - DNA, 18 bp, Artificial Sequence
  Synthetic DNA
aaattcgtttctctaaag

SEQ ID NO: 71896 - DNA, 18 bp, Artificial Sequence
  Synthetic DNA
aacaaagacacactatag

SEQ ID NO: 71897 - DNA, 18 bp, Artificial Sequence
  Synthetic DNA
aacaatgcagctccaaag

SEQ ID NO: 71898 - DNA, 18 bp, Artificial Sequence
  Synthetic DNA
aataaagactcactattg

SEQ ID NO: 71899 - DNA, 18 bp, Artificial Sequence
  Synthetic DNA
aataagaactgaatatag

SEQ ID NO: 71900 - DNA, 18 bp, Artificial Sequence
  Synthetic DNA
aatcaatacatacaatag

SEQ ID NO: 71901 - DNA, 18 bp, Artificial Sequence
  Synthetic DNA
aatcacgaatcactgtag

SEQ ID NO: 71902 - DNA, 18 bp, Artificial Sequence
  Synthetic DNA
aattaagtctcactaaag

SEQ ID NO: 71903 - DNA, 18 bp, Artificial Sequence
  Synthetic DNA
aattacaaatcactattg

SEQ ID NO: 71904 - DNA, 18 bp, Artificial Sequence
  Synthetic DNA
aattacgactttctattg

SEQ ID NO: 71905 - DNA, 18 bp, Artificial Sequence
  Synthetic DNA
aattatgactctccatag

SEQ ID NO: 71906 - DNA, 18 bp, Artificial Sequence
  Synthetic DNA
aattccgactcactaatg

SEQ ID NO: 71907 - DNA, 18 bp, Artificial Sequence
  Synthetic DNA
acattcgactaactagtg

SEQ ID NO: 71908 - DNA, 18 bp, Artificial Sequence
  Synthetic DNA
acattcgactcattattg

SEQ ID NO: 71909 - DNA, 18 bp, Artificial Sequence
  Synthetic DNA
actatcgattatcttttg

SEQ ID NO: 71910 - DNA, 18 bp, Artificial Sequence
  Synthetic DNA
actttcgactcactattg

SEQ ID NO: 71911 - DNA, 18 bp, Artificial Sequence
  Synthetic DNA
agataggtaccaatatag

SEQ ID NO: 71912 - DNA, 18 bp, Artificial Sequence
  Synthetic DNA
agatgctactcaatatag

SEQ ID NO: 71913 - DNA, 18 bp, Artificial Sequence
  Synthetic DNA
ataatcgtctcacaatag

SEQ ID NO: 71914 - DNA, 18 bp, Artificial Sequence
  Synthetic DNA
atacacgtcttattatag

SEQ ID NO: 71915 - DNA, 18 bp, Artificial Sequence
  Synthetic DNA
atatacaactctacatag

SEQ ID NO: 71916 - DNA, 18 bp, Artificial Sequence
  Synthetic DNA
atatacgacttacattag

SEQ ID NO: 71917 - DNA, 18 bp, Artificial Sequence
  Synthetic DNA
atatagggttcaagattg

SEQ ID NO: 71918 - DNA, 18 bp, Artificial Sequence
  Synthetic DNA
atatatggctcgctattg

SEQ ID NO: 71919 - DNA, 18 bp, Artificial Sequence
  Synthetic DNA
atttacgactcactgaag

SEQ ID NO: 71920 - DNA, 18 bp, Artificial Sequence
  Synthetic DNA
caaaacgattcacattag

SEQ ID NO: 71921 - DNA, 18 bp, Artificial Sequence
  Synthetic DNA
caaatcgtaacacaaaag

SEQ ID NO: 71922 - DNA, 18 bp, Artificial Sequence
  Synthetic DNA
caacatgtctctcgatag

SEQ ID NO: 71923 - DNA, 18 bp, Artificial Sequence
  Synthetic DNA
caataagactctctaatg

SEQ ID NO: 71924 - DNA, 18 bp, Artificial Sequence
  Synthetic DNA
caataaggcacactattg

SEQ ID NO: 71925 - DNA, 18 bp, Artificial Sequence
  Synthetic DNA
caatacgacacgatttag

SEQ ID NO: 71926 - DNA, 18 bp, Artificial Sequence
  Synthetic DNA
caatacgatctactatgg

SEQ ID NO: 71927 - DNA, 18 bp, Artificial Sequence
  Synthetic DNA
caatactgctcactaatg

SEQ ID NO: 71928 - DNA, 18 bp, Artificial Sequence
  Synthetic DNA
caatacttcatatttttg

SEQ ID NO: 71929 - DNA, 18 bp, Artificial Sequence
  Synthetic DNA
caataggccttactaaag

SEQ ID NO: 71930 - DNA, 18 bp, Artificial Sequence
  Synthetic DNA
caatatgctccactgtag

SEQ ID NO: 71931 - DNA, 18 bp, Artificial Sequence
  Synthetic DNA
caattcgacgctccatag

SEQ ID NO: 71932 - DNA, 18 bp, Artificial Sequence
  Synthetic DNA
caattcgcctcaccttag

SEQ ID NO: 71933 - DNA, 18 bp, Artificial Sequence
  Synthetic DNA
caattcggcacactattg

SEQ ID NO: 71934 - DNA, 18 bp, Artificial Sequence
  Synthetic DNA
caatttgacctattatag

SEQ ID NO: 71935 - DNA, 18 bp, Artificial Sequence
  Synthetic DNA
catcaccactcactttcg

SEQ ID NO: 71936 - DNA, 18 bp, Artificial Sequence
  Synthetic DNA
cattacgacacaatttag

SEQ ID NO: 71937 - DNA, 18 bp, Artificial Sequence
  Synthetic DNA
cattacgactatctgtag

SEQ ID NO: 71938 - DNA, 18 bp, Artificial Sequence
  Synthetic DNA
cattccgtgtcactaaag

SEQ ID NO: 71939 - DNA, 18 bp, Artificial Sequence
  Synthetic DNA
cattgggattcactaatg

SEQ ID NO: 71940 - DNA, 18 bp, Artificial Sequence
  Synthetic DNA
ccataccattctctaaag

SEQ ID NO: 71941 - DNA, 18 bp, Artificial Sequence
  Synthetic DNA
cctctcgactcactttag

SEQ ID NO: 71942 - DNA, 18 bp, Artificial Sequence
  Synthetic DNA
ctataagtttaacaatag

SEQ ID NO: 71943 - DNA, 18 bp, Artificial Sequence
  Synthetic DNA
ctatacgtcacactattg

SEQ ID NO: 71944 - DNA, 18 bp, Artificial Sequence
  Synthetic DNA
ctatatgactcgctttag

SEQ ID NO: 71945 - DNA, 18 bp, Artificial Sequence
  Synthetic DNA
ctattcgattcactatgg

SEQ ID NO: 71946 - DNA, 18 bp, Artificial Sequence
  Synthetic DNA
ctattctactcactattg

SEQ ID NO: 71947 - DNA, 18 bp, Artificial Sequence
  Synthetic DNA
ctcagctaatcaaagtag

SEQ ID NO: 71948 - DNA, 18 bp, Artificial Sequence
  Synthetic DNA
ctgtacgattcactacag

SEQ ID NO: 71949 - DNA, 18 bp, Artificial Sequence
  Synthetic DNA
ctttacgacttactttag

SEQ ID NO: 71950 - DNA, 18 bp, Artificial Sequence
  Synthetic DNA
gaacccgtctcactattg

SEQ ID NO: 71951 - DNA, 18 bp, Artificial Sequence
  Synthetic DNA
gaataagaatcattaaag

SEQ ID NO: 71952 - DNA, 18 bp, Artificial Sequence
  Synthetic DNA
gaatacgacactttctcg

SEQ ID NO: 71953 - DNA, 18 bp, Artificial Sequence
  Synthetic DNA
gattacggctcacaattg

SEQ ID NO: 71954 - DNA, 18 bp, Artificial Sequence
  Synthetic DNA
gcatttgtctcactatag

SEQ ID NO: 71955 - DNA, 18 bp, Artificial Sequence
  Synthetic DNA
gtaaacgtctccctatag

SEQ ID NO: 71956 - DNA, 18 bp, Artificial Sequence
  Synthetic DNA
gtacacgattcaataaag

SEQ ID NO: 71957 - DNA, 18 bp, Artificial Sequence
  Synthetic DNA
gtataattcacaatatag

SEQ ID NO: 71958 - DNA, 18 bp, Artificial Sequence
  Synthetic DNA
taaaaacactttaaacag

SEQ ID NO: 71959 - DNA, 18 bp, Artificial Sequence
  Synthetic DNA
taaaacaactcaacatgg

SEQ ID NO: 71960 - DNA, 18 bp, Artificial Sequence
  Synthetic DNA
taaaacagctcacttctg

SEQ ID NO: 71961 - DNA, 18 bp, Artificial Sequence
  Synthetic DNA
taaaacgactgattcatg

SEQ ID NO: 71962 - DNA, 18 bp, Artificial Sequence
  Synthetic DNA
taaaacgatactcaatag

SEQ ID NO: 71963 - DNA, 18 bp, Artificial Sequence
  Synthetic DNA
taaaacgccactcttttg

SEQ ID NO: 71964 - DNA, 18 bp, Artificial Sequence
  Synthetic DNA
taaaacggtgtagtatag

SEQ ID NO: 71965 - DNA, 18 bp, Artificial Sequence
  Synthetic DNA
taaaacgtctctctctgg

SEQ ID NO: 71966 - DNA, 18 bp, Artificial Sequence
  Synthetic DNA
taaaacgtgtatctatag

SEQ ID NO: 71967 - DNA, 18 bp, Artificial Sequence
  Synthetic DNA
taaaactcttcattatag

SEQ ID NO: 71968 - DNA, 18 bp, Artificial Sequence
  Synthetic DNA
taaaaggatacacaattg

SEQ ID NO: 71969 - DNA, 18 bp, Artificial Sequence
  Synthetic DNA
taaaatgactcacatacg

SEQ ID NO: 71970 - DNA, 18 bp, Artificial Sequence
  Synthetic DNA
taaaattacacagtttaa

SEQ ID NO: 71971 - DNA, 18 bp, Artificial Sequence
  Synthetic DNA
taaagcaacatactctgg

SEQ ID NO: 71972 - DNA, 18 bp, Artificial Sequence
  Synthetic DNA
taaatcgactctatatgg

SEQ ID NO: 71973 - DNA, 18 bp, Artificial Sequence
  Synthetic DNA
taaatctaattactatag

SEQ ID NO: 71974 - DNA, 18 bp, Artificial Sequence
  Synthetic DNA
taacaccaaacaatatag

SEQ ID NO: 71975 - DNA, 18 bp, Artificial Sequence
  Synthetic DNA
taacacgactacacatag

SEQ ID NO: 71976 - DNA, 18 bp, Artificial Sequence
  Synthetic DNA
taacacgtttgactttag

SEQ ID NO: 71977 - DNA, 18 bp, Artificial Sequence
  Synthetic DNA
taactcgccatgggaacg

SEQ ID NO: 71978 - DNA, 18 bp, Artificial Sequence
  Synthetic DNA
taactcgtttcactattg

SEQ ID NO: 71979 - DNA, 18 bp, Artificial Sequence
  Synthetic DNA
taacttgactaactttag

SEQ ID NO: 71980 - DNA, 18 bp, Artificial Sequence
  Synthetic DNA
taagacgatacccaatag

SEQ ID NO: 71981 - DNA, 18 bp, Artificial Sequence
  Synthetic DNA
taataaaccaaactaagg

SEQ ID NO: 71982 - DNA, 18 bp, Artificial Sequence
  Synthetic DNA
taataacatcctaaatag

SEQ ID NO: 71983 - DNA, 18 bp, Artificial Sequence
  Synthetic DNA
taataagtgtctctattg

SEQ ID NO: 71984 - DNA, 18 bp, Artificial Sequence
  Synthetic DNA
taataagtgttactatgg

SEQ ID NO: 71985 - DNA, 18 bp, Artificial Sequence
  Synthetic DNA
taataagtttgtttatag

SEQ ID NO: 71986 - DNA, 18 bp, Artificial Sequence
  Synthetic DNA
taatacaactcccatttg

SEQ ID NO: 71987 - DNA, 18 bp, Artificial Sequence
  Synthetic DNA
taatacaactgtctaatg

SEQ ID NO: 71988 - DNA, 18 bp, Artificial Sequence
  Synthetic DNA
taatacaattcattactg

SEQ ID NO: 71989 - DNA, 18 bp, Artificial Sequence
  Synthetic DNA
taatacccctcactcatg

SEQ ID NO: 71990 - DNA, 18 bp, Artificial Sequence
  Synthetic DNA
taatacccctcagttaag

SEQ ID NO: 71991 - DNA, 18 bp, Artificial Sequence
  Synthetic DNA
taatacctctatctaaag

SEQ ID NO: 71992 - DNA, 18 bp, Artificial Sequence
  Synthetic DNA
taatacgacacatactgg

SEQ ID NO: 71993 - DNA, 18 bp, Artificial Sequence
  Synthetic DNA
taatacgacacatcaatg

SEQ ID NO: 71994 - DNA, 18 bp, Artificial Sequence
  Synthetic DNA
taatacgacacccttctg

SEQ ID NO: 71995 - DNA, 18 bp, Artificial Sequence
  Synthetic DNA
taatacgacgttatttag

SEQ ID NO: 71996 - DNA, 18 bp, Artificial Sequence
  Synthetic DNA
taatacgactcaaatagg

SEQ ID NO: 71997 - DNA, 18 bp, Artificial Sequence
  Synthetic DNA
taatacgagttattcaag

SEQ ID NO: 71998 - DNA, 18 bp, Artificial Sequence
  Synthetic DNA
taatacgcatctcattag

SEQ ID NO: 71999 - DNA, 18 bp, Artificial Sequence
  Synthetic DNA
taatacggcattctttag

SEQ ID NO: 72000 - DNA, 18 bp, Artificial Sequence
  Synthetic DNA
taatacggctcagattcg

SEQ ID NO: 72001 - DNA, 18 bp, Artificial Sequence
  Synthetic DNA
taatacgtcaaactaagg

SEQ ID NO: 72002 - DNA, 18 bp, Artificial Sequence
  Synthetic DNA
taatacgtcagtctaaag

SEQ ID NO: 72003 - DNA, 18 bp, Artificial Sequence
  Synthetic DNA
taatacgtctcacatgtg

SEQ ID NO: 72004 - DNA, 18 bp, Artificial Sequence
  Synthetic DNA
taatacgtctccccaaaa

SEQ ID NO: 72005 - DNA, 18 bp, Artificial Sequence
  Synthetic DNA
taatacgtcttatttaag

SEQ ID NO: 72006 - DNA, 18 bp, Artificial Sequence
  Synthetic DNA
taatacgttaaaccatag

SEQ ID NO: 72007 - DNA, 18 bp, Artificial Sequence
  Synthetic DNA
taatacgttagagtaaag

SEQ ID NO: 72008 - DNA, 18 bp, Artificial Sequence
  Synthetic DNA
taatactacactcttttg

SEQ ID NO: 72009 - DNA, 18 bp, Artificial Sequence
  Synthetic DNA
taatactatacacaaaag

SEQ ID NO: 72010 - DNA, 18 bp, Artificial Sequence
  Synthetic DNA
taatacttctctcttttg

SEQ ID NO: 72011 - DNA, 18 bp, Artificial Sequence
  Synthetic DNA
taataggacacacattcg

SEQ ID NO: 72012 - DNA, 18 bp, Artificial Sequence
  Synthetic DNA
taataggactctattaag

SEQ ID NO: 72013 - DNA, 18 bp, Artificial Sequence
  Synthetic DNA
taatataactcacatttg

SEQ ID NO: 72014 - DNA, 18 bp, Artificial Sequence
  Synthetic DNA
taatatgactaacttatg

SEQ ID NO: 72015 - DNA, 18 bp, Artificial Sequence
  Synthetic DNA
taatatggctaactctcg

SEQ ID NO: 72016 - DNA, 18 bp, Artificial Sequence
  Synthetic DNA
taatatgtctcacttatg

SEQ ID NO: 72017 - DNA, 18 bp, Artificial Sequence
  Synthetic DNA
taatcagactctttttag

SEQ ID NO: 72018 - DNA, 18 bp, Artificial Sequence
  Synthetic DNA
taatcctacgcacttaag

SEQ ID NO: 72019 - DNA, 18 bp, Artificial Sequence
  Synthetic DNA
taatcctattaacaatag

SEQ ID NO: 72020 - DNA, 18 bp, Artificial Sequence
  Synthetic DNA
taatctgaatcaccttag

SEQ ID NO: 72021 - DNA, 18 bp, Artificial Sequence
  Synthetic DNA
taatgattatttcaaatg

SEQ ID NO: 72022 - DNA, 18 bp, Artificial Sequence
  Synthetic DNA
taatgcaactcgcattag

SEQ ID NO: 72023 - DNA, 18 bp, Artificial Sequence
  Synthetic DNA
taatgcgactgaatcaag

SEQ ID NO: 72024 - DNA, 18 bp, Artificial Sequence
  Synthetic DNA
taatgcgtaaccctatag

SEQ ID NO: 72025 - DNA, 18 bp, Artificial Sequence
  Synthetic DNA
taatgcgttccattatag

SEQ ID NO: 72026 - DNA, 18 bp, Artificial Sequence
  Synthetic DNA
taattaaaatttcttttg

SEQ ID NO: 72027 - DNA, 18 bp, Artificial Sequence
  Synthetic DNA
taattactctcagtatag

SEQ ID NO: 72028 - DNA, 18 bp, Artificial Sequence
  Synthetic DNA
taattagacacgctaaag

SEQ ID NO: 72029 - DNA, 18 bp, Artificial Sequence
  Synthetic DNA
taattagcctcgatcatg

SEQ ID NO: 72030 - DNA, 18 bp, Artificial Sequence
  Synthetic DNA
taattattctcactaaag

SEQ ID NO: 72031 - DNA, 18 bp, Artificial Sequence
  Synthetic DNA
taattcatcttactaaag

SEQ ID NO: 72032 - DNA, 18 bp, Artificial Sequence
  Synthetic DNA
taattcatcttagtctag

SEQ ID NO: 72033 - DNA, 18 bp, Artificial Sequence
  Synthetic DNA
taattcctctcctttaag

SEQ ID NO: 72034 - DNA, 18 bp, Artificial Sequence
  Synthetic DNA
taattcgaccatcattag

SEQ ID NO: 72035 - DNA, 18 bp, Artificial Sequence
  Synthetic DNA
taattcgacgcttttttg

SEQ ID NO: 72036 - DNA, 18 bp, Artificial Sequence
  Synthetic DNA
taattcgtcaaacatttg

SEQ ID NO: 72037 - DNA, 18 bp, Artificial Sequence
  Synthetic DNA
taattcgtctcactgagg

SEQ ID NO: 72038 - DNA, 18 bp, Artificial Sequence
  Synthetic DNA
taattctactaattaaag

SEQ ID NO: 72039 - DNA, 18 bp, Artificial Sequence
  Synthetic DNA
taattggactcgcttaag

SEQ ID NO: 72040 - DNA, 18 bp, Artificial Sequence
  Synthetic DNA
tacaacgacacattttag

SEQ ID NO: 72041 - DNA, 18 bp, Artificial Sequence
  Synthetic DNA
tacaattactaacaattg

SEQ ID NO: 72042 - DNA, 18 bp, Artificial Sequence
  Synthetic DNA
tacacggtcttaaaatag

SEQ ID NO: 72043 - DNA, 18 bp, Artificial Sequence
  Synthetic DNA
taccacaacacactattg

SEQ ID NO: 72044 - DNA, 18 bp, Artificial Sequence
  Synthetic DNA
taccacgaatcacttttg

SEQ ID NO: 72045 - DNA, 18 bp, Artificial Sequence
  Synthetic DNA
tactaagactctataagg

SEQ ID NO: 72046 - DNA, 18 bp, Artificial Sequence
  Synthetic DNA
tactacgactctgaattg

SEQ ID NO: 72047 - DNA, 18 bp, Artificial Sequence
  Synthetic DNA
tactactacacattacag

SEQ ID NO: 72048 - DNA, 18 bp, Artificial Sequence
  Synthetic DNA
tactcccatccactatgg

SEQ ID NO: 72049 - DNA, 18 bp, Artificial Sequence
  Synthetic DNA
tacttcaagtcagtttag

SEQ ID NO: 72050 - DNA, 18 bp, Artificial Sequence
  Synthetic DNA
tagaacgtctcattattg

SEQ ID NO: 72051 - DNA, 18 bp, Artificial Sequence
  Synthetic DNA
tagaactacttactattg

SEQ ID NO: 72052 - DNA, 18 bp, Artificial Sequence
  Synthetic DNA
tagcacatctcactaaag

SEQ ID NO: 72053 - DNA, 18 bp, Artificial Sequence
  Synthetic DNA
tagcacgtcatactatag

SEQ ID NO: 72054 - DNA, 18 bp, Artificial Sequence
  Synthetic DNA
tagtaacgcatacaatgg

SEQ ID NO: 72055 - DNA, 18 bp, Artificial Sequence
  Synthetic DNA
tagtacgtcaccctttag

SEQ ID NO: 72056 - DNA, 18 bp, Artificial Sequence
  Synthetic DNA
tagtacgtctctcttacg

SEQ ID NO: 72057 - DNA, 18 bp, Artificial Sequence
  Synthetic DNA
tagtactacacataattg

SEQ ID NO: 72058 - DNA, 18 bp, Artificial Sequence
  Synthetic DNA
tagtatggatcactctag

SEQ ID NO: 72059 - DNA, 18 bp, Artificial Sequence
  Synthetic DNA
tagtattactcacttttg

SEQ ID NO: 72060 - DNA, 18 bp, Artificial Sequence
  Synthetic DNA
tataacaactctctatcg

SEQ ID NO: 72061 - DNA, 18 bp, Artificial Sequence
  Synthetic DNA
tataacgaaacactctag

SEQ ID NO: 72062 - DNA, 18 bp, Artificial Sequence
  Synthetic DNA
tataacgacactctgtag

SEQ ID NO: 72063 - DNA, 18 bp, Artificial Sequence
  Synthetic DNA
tataacgaccaacaatag

SEQ ID NO: 72064 - DNA, 18 bp, Artificial Sequence
  Synthetic DNA
tataacgactttatatag

SEQ ID NO: 72065 - DNA, 18 bp, Artificial Sequence
  Synthetic DNA
tataacgcgtcattatag

SEQ ID NO: 72066 - DNA, 18 bp, Artificial Sequence
  Synthetic DNA
tataatgactctctctag

SEQ ID NO: 72067 - DNA, 18 bp, Artificial Sequence
  Synthetic DNA
tatagcaactcaccactg

SEQ ID NO: 72068 - DNA, 18 bp, Artificial Sequence
  Synthetic DNA
tatatcgacacacaatag

SEQ ID NO: 72069 - DNA, 18 bp, Artificial Sequence
  Synthetic DNA
tatatcgactgactcaag

SEQ ID NO: 72070 - DNA, 18 bp, Artificial Sequence
  Synthetic DNA
tatcactattagctatag

SEQ ID NO: 72071 - DNA, 18 bp, Artificial Sequence
  Synthetic DNA
tatcccgagagacaagtg

SEQ ID NO: 72072 - DNA, 18 bp, Artificial Sequence
  Synthetic DNA
tatgacttctcacaatag

SEQ ID NO: 72073 - DNA, 18 bp, Artificial Sequence
  Synthetic DNA
tattaagactttcaatag

SEQ ID NO: 72074 - DNA, 18 bp, Artificial Sequence
  Synthetic DNA
tattacaacacactaatg

SEQ ID NO: 72075 - DNA, 18 bp, Artificial Sequence
  Synthetic DNA
tattacacctcactgaag

SEQ ID NO: 72076 - DNA, 18 bp, Artificial Sequence
  Synthetic DNA
tattaccacccattattg

SEQ ID NO: 72077 - DNA, 18 bp, Artificial Sequence
  Synthetic DNA
tattacctcttactaaag

SEQ ID NO: 72078 - DNA, 18 bp, Artificial Sequence
  Synthetic DNA
tattacgaaccacagtag

SEQ ID NO: 72079 - DNA, 18 bp, Artificial Sequence
  Synthetic DNA
tattacgacccatttttg

SEQ ID NO: 72080 - DNA, 18 bp, Artificial Sequence
  Synthetic DNA
tattacgactcaacaatg

SEQ ID NO: 72081 - DNA, 18 bp, Artificial Sequence
  Synthetic DNA
tattacgactctgtctcg

SEQ ID NO: 72082 - DNA, 18 bp, Artificial Sequence
  Synthetic DNA
tattacgactgtcttctg

SEQ ID NO: 72083 - DNA, 18 bp, Artificial Sequence
  Synthetic DNA
tattacgattctctaatg

SEQ ID NO: 72084 - DNA, 18 bp, Artificial Sequence
  Synthetic DNA
tattacgtataacaatag

SEQ ID NO: 72085 - DNA, 18 bp, Artificial Sequence
  Synthetic DNA
tattacgtatctgtaaag

SEQ ID NO: 72086 - DNA, 18 bp, Artificial Sequence
  Synthetic DNA
tattacgtttcggtatag

SEQ ID NO: 72087 - DNA, 18 bp, Artificial Sequence
  Synthetic DNA
tattacgtttctcattcg

SEQ ID NO: 72088 - DNA, 18 bp, Artificial Sequence
  Synthetic DNA
tattactaatcactgaag

SEQ ID NO: 72089 - DNA, 18 bp, Artificial Sequence
  Synthetic DNA
tattactactcactcctg

SEQ ID NO: 72090 - DNA, 18 bp, Artificial Sequence
  Synthetic DNA
tattaggactccgtattg

SEQ ID NO: 72091 - DNA, 18 bp, Artificial Sequence
  Synthetic DNA
tattatgatgctcaatag

SEQ ID NO: 72092 - DNA, 18 bp, Artificial Sequence
  Synthetic DNA
tattcatacttgctgttg

SEQ ID NO: 72093 - DNA, 18 bp, Artificial Sequence
  Synthetic DNA
tattccgattccatatag

SEQ ID NO: 72094 - DNA, 18 bp, Artificial Sequence
  Synthetic DNA
tattgcttctctctatag

SEQ ID NO: 72095 - DNA, 18 bp, Artificial Sequence
  Synthetic DNA
tattgttactatatattg

SEQ ID NO: 72096 - DNA, 18 bp, Artificial Sequence
  Synthetic DNA
tatttcgactaagtcaag

SEQ ID NO: 72097 - DNA, 18 bp, Artificial Sequence
  Synthetic DNA
tatttcgactcccaaaag

SEQ ID NO: 72098 - DNA, 18 bp, Artificial Sequence
  Synthetic DNA
tcatacgactaaacgtag

SEQ ID NO: 72099 - DNA, 18 bp, Artificial Sequence
  Synthetic DNA
tcatacgtcatcctatag

SEQ ID NO: 72100 - DNA, 18 bp, Artificial Sequence
  Synthetic DNA
tcattcgactctcttaag

SEQ ID NO: 72101 - DNA, 18 bp, Artificial Sequence
  Synthetic DNA
tcattcgtctcaatttag

SEQ ID NO: 72102 - DNA, 18 bp, Artificial Sequence
  Synthetic DNA
tccttcgtttcactcttg

SEQ ID NO: 72103 - DNA, 18 bp, Artificial Sequence
  Synthetic DNA
tctgtcgtctcgcgattg

SEQ ID NO: 72104 - DNA, 18 bp, Artificial Sequence
  Synthetic DNA
tgacttgactcattatag

SEQ ID NO: 72105 - DNA, 18 bp, Artificial Sequence
  Synthetic DNA
tgatacttcacacttaag

SEQ ID NO: 72106 - DNA, 18 bp, Artificial Sequence
  Synthetic DNA
tgatatgtcactcaatag

SEQ ID NO: 72107 - DNA, 18 bp, Artificial Sequence
  Synthetic DNA
tgattatacaaactattg

SEQ ID NO: 72108 - DNA, 18 bp, Artificial Sequence
  Synthetic DNA
tgattcgaatcattatgg

SEQ ID NO: 72109 - DNA, 18 bp, Artificial Sequence
  Synthetic DNA
tgattcgacacacaaaag

SEQ ID NO: 72110 - DNA, 18 bp, Artificial Sequence
  Synthetic DNA
tgattcgcctcacaattg

SEQ ID NO: 72111 - DNA, 18 bp, Artificial Sequence
  Synthetic DNA
tgatttgattctctatag

SEQ ID NO: 72112 - DNA, 18 bp, Artificial Sequence
  Synthetic DNA
tggtgcgagtctttatag

SEQ ID NO: 72113 - DNA, 18 bp, Artificial Sequence
  Synthetic DNA
tgtaacgaatctctatag

SEQ ID NO: 72114 - DNA, 18 bp, Artificial Sequence
  Synthetic DNA
tgttaagacatactttag

SEQ ID NO: 72115 - DNA, 18 bp, Artificial Sequence
  Synthetic DNA
ttaaaagtttcactaaag

SEQ ID NO: 72116 - DNA, 18 bp, Artificial Sequence
  Synthetic DNA
ttaaacaattaactttag

SEQ ID NO: 72117 - DNA, 18 bp, Artificial Sequence
  Synthetic DNA
ttaaacttctcacccttg

SEQ ID NO: 72118 - DNA, 18 bp, Artificial Sequence
  Synthetic DNA
ttaaccgtctcactatgg

SEQ ID NO: 72119 - DNA, 18 bp, Artificial Sequence
  Synthetic DNA
ttaagcgactcacatttg

SEQ ID NO: 72120 - DNA, 18 bp, Artificial Sequence
  Synthetic DNA
ttaatccagatactatgg

SEQ ID NO: 72121 - DNA, 18 bp, Artificial Sequence
  Synthetic DNA
ttaatcgaatcactatcg

SEQ ID NO: 72122 - DNA, 18 bp, Artificial Sequence
  Synthetic DNA
ttaatcgtctcgttaaag

SEQ ID NO: 72123 - DNA, 18 bp, Artificial Sequence
  Synthetic DNA
ttacacgtctcacttcag

SEQ ID NO: 72124 - DNA, 18 bp, Artificial Sequence
  Synthetic DNA
ttaccctagtcactctag

SEQ ID NO: 72125 - DNA, 18 bp, Artificial Sequence
  Synthetic DNA
ttactctacgcactttag

SEQ ID NO: 72126 - DNA, 18 bp, Artificial Sequence
  Synthetic DNA
ttataacagtcattatag

SEQ ID NO: 72127 - DNA, 18 bp, Artificial Sequence
  Synthetic DNA
ttataagacacaaaatag

SEQ ID NO: 72128 - DNA, 18 bp, Artificial Sequence
  Synthetic DNA
ttataagacttgctattg

SEQ ID NO: 72129 - DNA, 18 bp, Artificial Sequence
  Synthetic DNA
ttataagtcactctatag

SEQ ID NO: 72130 - DNA, 18 bp, Artificial Sequence
  Synthetic DNA
ttataagtctcactaatg

SEQ ID NO: 72131 - DNA, 18 bp, Artificial Sequence
  Synthetic DNA
ttataccactgcctttag

SEQ ID NO: 72132 - DNA, 18 bp, Artificial Sequence
  Synthetic DNA
ttatacgaaactctttag

SEQ ID NO: 72133 - DNA, 18 bp, Artificial Sequence
  Synthetic DNA
ttatacgtaacataagag

SEQ ID NO: 72134 - DNA, 18 bp, Artificial Sequence
  Synthetic DNA
ttatactactcgctttcg

SEQ ID NO: 72135 - DNA, 18 bp, Artificial Sequence
  Synthetic DNA
ttatactacttacaacag

SEQ ID NO: 72136 - DNA, 18 bp, Artificial Sequence
  Synthetic DNA
ttatatcacgcaccatag

SEQ ID NO: 72137 - DNA, 18 bp, Artificial Sequence
  Synthetic DNA
ttatatcatttattttag

SEQ ID NO: 72138 - DNA, 18 bp, Artificial Sequence
  Synthetic DNA
ttatcccactcacttcag

SEQ ID NO: 72139 - DNA, 18 bp, Artificial Sequence
  Synthetic DNA
ttatccgacacgctacgg

SEQ ID NO: 72140 - DNA, 18 bp, Artificial Sequence
  Synthetic DNA
ttatccgacccgcaatag

SEQ ID NO: 72141 - DNA, 18 bp, Artificial Sequence
  Synthetic DNA
ttatccgactcttacaag

SEQ ID NO: 72142 - DNA, 18 bp, Artificial Sequence
  Synthetic DNA
ttatccgccttacaatag

SEQ ID NO: 72143 - DNA, 18 bp, Artificial Sequence
  Synthetic DNA
ttatgagacccgttatag

SEQ ID NO: 72144 - DNA, 18 bp, Artificial Sequence
  Synthetic DNA
ttatgctaccccctcttg

SEQ ID NO: 72145 - DNA, 18 bp, Artificial Sequence
  Synthetic DNA
ttattcaaatctctatag

SEQ ID NO: 72146 - DNA, 18 bp, Artificial Sequence
  Synthetic DNA
ttattcaactatctaatg

SEQ ID NO: 72147 - DNA, 18 bp, Artificial Sequence
  Synthetic DNA
ttattcctctcactatcg

SEQ ID NO: 72148 - DNA, 18 bp, Artificial Sequence
  Synthetic DNA
ttattcgcgtcacttgag

SEQ ID NO: 72149 - DNA, 18 bp, Artificial Sequence
  Synthetic DNA
ttattcggctcttattag

SEQ ID NO: 72150 - DNA, 18 bp, Artificial Sequence
  Synthetic DNA
ttattcgtccaagtgtcg

SEQ ID NO: 72151 - DNA, 18 bp, Artificial Sequence
  Synthetic DNA
ttatttgacccagattgg

SEQ ID NO: 72152 - DNA, 18 bp, Artificial Sequence
  Synthetic DNA
ttcattcactcacaatag

SEQ ID NO: 72153 - DNA, 18 bp, Artificial Sequence
  Synthetic DNA
ttccatgacttactattg

SEQ ID NO: 72154 - DNA, 18 bp, Artificial Sequence
  Synthetic DNA
ttctagcacgcactatag

SEQ ID NO: 72155 - DNA, 18 bp, Artificial Sequence
  Synthetic DNA
ttctaggactcaataaag

SEQ ID NO: 72156 - DNA, 18 bp, Artificial Sequence
  Synthetic DNA
ttgtaagactgtttatcg

SEQ ID NO: 72157 - DNA, 18 bp, Artificial Sequence
  Synthetic DNA
ttgtatgattctctccag

SEQ ID NO: 72158 - DNA, 18 bp, Artificial Sequence
  Synthetic DNA
tttaatttctcaaaatag

SEQ ID NO: 72159 - DNA, 18 bp, Artificial Sequence
  Synthetic DNA
tttattcaatcactatag

SEQ ID NO: 72160 - DNA, 18 bp, Artificial Sequence
  Synthetic DNA
tttcacgactcacattgg

SEQ ID NO: 72161 - DNA, 18 bp, Artificial Sequence
  Synthetic DNA
tttcacgactcacttttg

SEQ ID NO: 72162 - DNA, 18 bp, Artificial Sequence
  Synthetic DNA
tttgacgtctaactatag

SEQ ID NO: 72163 - DNA, 18 bp, Artificial Sequence
  Synthetic DNA
ttttaagcctctctatag

SEQ ID NO: 72164 - DNA, 18 bp, Artificial Sequence
  Synthetic DNA
ttttacatctcagtatag

SEQ ID NO: 72165 - DNA, 18 bp, Artificial Sequence
  Synthetic DNA
ttttacgtctcattaaag

SEQ ID NO: 72166 - DNA, 18 bp, Artificial Sequence
  Synthetic DNA
ttttatgactttctatag

SEQ ID NO: 72167 - DNA, 18 bp, Artificial Sequence
  Synthetic DNA
tttttcgacttattatag

SEQ ID NO: 72168 - DNA, 18 bp, Artificial Sequence
  Synthetic DNA
tttttcgagacactatag

SEQ ID NO: 72169 - DNA, 18 bp, Artificial Sequence
  Synthetic DNA
ttataccgctcaatctag

SEQ ID NO: 72170 - DNA, 18 bp, Artificial Sequence
  Synthetic DNA
ttattcgattctctattg

SEQ ID NO: 72171 - DNA, 18 bp, Artificial Sequence
  Synthetic DNA
aaaaacgaatcacattag

SEQ ID NO: 72172 - DNA, 18 bp, Artificial Sequence
  Synthetic DNA
aaaaacgactgtatattg

SEQ ID NO: 72173 - DNA, 18 bp, Artificial Sequence
  Synthetic DNA
aaaatcgaatcacaatgg

SEQ ID NO: 72174 - DNA, 18 bp, Artificial Sequence
  Synthetic DNA
aaaatttactctctatag

SEQ ID NO: 72175 - DNA, 18 bp, Artificial Sequence
  Synthetic DNA
aaacacgactcccttgag

SEQ ID NO: 72176 - DNA, 18 bp, Artificial Sequence
  Synthetic DNA
aaacgccactcactattg

SEQ ID NO: 72177 - DNA, 18 bp, Artificial Sequence
  Synthetic DNA
aaactcatcccactattg

SEQ ID NO: 72178 - DNA, 18 bp, Artificial Sequence
  Synthetic DNA
aaataattctcgctatcg

SEQ ID NO: 72179 - DNA, 18 bp, Artificial Sequence
  Synthetic DNA
aaatacctatcattatag

SEQ ID NO: 72180 - DNA, 18 bp, Artificial Sequence
  Synthetic DNA
aaatacgacccagtactg

SEQ ID NO: 72181 - DNA, 18 bp, Artificial Sequence
  Synthetic DNA
aaatacgactctttaatg

SEQ ID NO: 72182 - DNA, 18 bp, Artificial Sequence
  Synthetic DNA
aaatacgagtcgcaaacg

SEQ ID NO: 72183 - DNA, 18 bp, Artificial Sequence
  Synthetic DNA
aaatactactcaatgaag

SEQ ID NO: 72184 - DNA, 18 bp, Artificial Sequence
  Synthetic DNA
aaatacttgtcactaatg

SEQ ID NO: 72185 - DNA, 18 bp, Artificial Sequence
  Synthetic DNA
aaatatgactcgctgttg

SEQ ID NO: 72186 - DNA, 18 bp, Artificial Sequence
  Synthetic DNA
aaatccgtctcactgaag

SEQ ID NO: 72187 - DNA, 18 bp, Artificial Sequence
  Synthetic DNA
aaattccactcactgaag

SEQ ID NO: 72188 - DNA, 18 bp, Artificial Sequence
  Synthetic DNA
aaattcgaatcactttcg

SEQ ID NO: 72189 - DNA, 18 bp, Artificial Sequence
  Synthetic DNA
aaattcgatccactcaag

SEQ ID NO: 72190 - DNA, 18 bp, Artificial Sequence
  Synthetic DNA
aaattcgtcaccctattg

SEQ ID NO: 72191 - DNA, 18 bp, Artificial Sequence
  Synthetic DNA
aactactactcactaatg

SEQ ID NO: 72192 - DNA, 18 bp, Artificial Sequence
  Synthetic DNA
aagtacaacttactgtag

SEQ ID NO: 72193 - DNA, 18 bp, Artificial Sequence
  Synthetic DNA
aagttcgactttcaatcg

SEQ ID NO: 72194 - DNA, 18 bp, Artificial Sequence
  Synthetic DNA
aatcacgactcaataatg

SEQ ID NO: 72195 - DNA, 18 bp, Artificial Sequence
  Synthetic DNA
aatgaataccccctatag

SEQ ID NO: 72196 - DNA, 18 bp, Artificial Sequence
  Synthetic DNA
aattacgacacacaaaag

SEQ ID NO: 72197 - DNA, 18 bp, Artificial Sequence
  Synthetic DNA
aattacgactctgtattg

SEQ ID NO: 72198 - DNA, 18 bp, Artificial Sequence
  Synthetic DNA
aattacgactgatagtag

SEQ ID NO: 72199 - DNA, 18 bp, Artificial Sequence
  Synthetic DNA
aatttcaacacactattg

SEQ ID NO: 72200 - DNA, 18 bp, Artificial Sequence
  Synthetic DNA
aatttcgattcactacag

SEQ ID NO: 72201 - DNA, 18 bp, Artificial Sequence
  Synthetic DNA
agatacgccttactaaag

SEQ ID NO: 72202 - DNA, 18 bp, Artificial Sequence
  Synthetic DNA
agatacgtctaactttag

SEQ ID NO: 72203 - DNA, 18 bp, Artificial Sequence
  Synthetic DNA
ataaacgacagactttgg

SEQ ID NO: 72204 - DNA, 18 bp, Artificial Sequence
  Synthetic DNA
ataaactattcactatag

SEQ ID NO: 72205 - DNA, 18 bp, Artificial Sequence
  Synthetic DNA
atacacgactcataatag

SEQ ID NO: 72206 - DNA, 18 bp, Artificial Sequence
  Synthetic DNA
atacactactcactgtag

SEQ ID NO: 72207 - DNA, 18 bp, Artificial Sequence
  Synthetic DNA
atataactctcactatag

SEQ ID NO: 72208 - DNA, 18 bp, Artificial Sequence
  Synthetic DNA
atatacaactcaatattg

SEQ ID NO: 72209 - DNA, 18 bp, Artificial Sequence
  Synthetic DNA
atatacaactctcaatag

SEQ ID NO: 72210 - DNA, 18 bp, Artificial Sequence
  Synthetic DNA
atataccactcacttttg

SEQ ID NO: 72211 - DNA, 18 bp, Artificial Sequence
  Synthetic DNA
atatacgaaacactattg

SEQ ID NO: 72212 - DNA, 18 bp, Artificial Sequence
  Synthetic DNA
atatacgactatcgatgg

SEQ ID NO: 72213 - DNA, 18 bp, Artificial Sequence
  Synthetic DNA
atatacgctttactatag

SEQ ID NO: 72214 - DNA, 18 bp, Artificial Sequence
  Synthetic DNA
atattcgactcactgtcg

SEQ ID NO: 72215 - DNA, 18 bp, Artificial Sequence
  Synthetic DNA
atattcgactctctaaag

SEQ ID NO: 72216 - DNA, 18 bp, Artificial Sequence
  Synthetic DNA
atattctattcactatag

SEQ ID NO: 72217 - DNA, 18 bp, Artificial Sequence
  Synthetic DNA
attaagaactcactaaag

SEQ ID NO: 72218 - DNA, 18 bp, Artificial Sequence
  Synthetic DNA
atttaacagtcactatag

SEQ ID NO: 72219 - DNA, 18 bp, Artificial Sequence
  Synthetic DNA
caaaacgatacacaatag

SEQ ID NO: 72220 - DNA, 18 bp, Artificial Sequence
  Synthetic DNA
caatacatcaaattacag

SEQ ID NO: 72221 - DNA, 18 bp, Artificial Sequence
  Synthetic DNA
caatacgactaaggaaag

SEQ ID NO: 72222 - DNA, 18 bp, Artificial Sequence
  Synthetic DNA
caatacgtgtcatgattg

SEQ ID NO: 72223 - DNA, 18 bp, Artificial Sequence
  Synthetic DNA
caatccgactccctttac

SEQ ID NO: 72224 - DNA, 18 bp, Artificial Sequence
  Synthetic DNA
cactacgattcaaaatag

SEQ ID NO: 72225 - DNA, 18 bp, Artificial Sequence
  Synthetic DNA
catcactactctctttag

SEQ ID NO: 72226 - DNA, 18 bp, Artificial Sequence
  Synthetic DNA
ccacacgaccttctattg

SEQ ID NO: 72227 - DNA, 18 bp, Artificial Sequence
  Synthetic DNA
cgattcgactcccagtag

SEQ ID NO: 72228 - DNA, 18 bp, Artificial Sequence
  Synthetic DNA
ctatacaactcgctatgg

SEQ ID NO: 72229 - DNA, 18 bp, Artificial Sequence
  Synthetic DNA
ctataccactcactaatg

SEQ ID NO: 72230 - DNA, 18 bp, Artificial Sequence
  Synthetic DNA
ctatacgatcgattttag

SEQ ID NO: 72231 - DNA, 18 bp, Artificial Sequence
  Synthetic DNA
ctctacgattcactatgg

SEQ ID NO: 72232 - DNA, 18 bp, Artificial Sequence
  Synthetic DNA
gaaaacgactcttaatag

SEQ ID NO: 72233 - DNA, 18 bp, Artificial Sequence
  Synthetic DNA
gaaacttaccaaccatag

SEQ ID NO: 72234 - DNA, 18 bp, Artificial Sequence
  Synthetic DNA
gaatccatctcactttag

SEQ ID NO: 72235 - DNA, 18 bp, Artificial Sequence
  Synthetic DNA
gagtcagactctttacag

SEQ ID NO: 72236 - DNA, 18 bp, Artificial Sequence
  Synthetic DNA
gtatgcgacttactaaag

SEQ ID NO: 72237 - DNA, 18 bp, Artificial Sequence
  Synthetic DNA
taaaaagattcattgtag

SEQ ID NO: 72238 - DNA, 18 bp, Artificial Sequence
  Synthetic DNA
taaaacaaatcactaatg

SEQ ID NO: 72239 - DNA, 18 bp, Artificial Sequence
  Synthetic DNA
taaaacaactataattcg

SEQ ID NO: 72240 - DNA, 18 bp, Artificial Sequence
  Synthetic DNA
taaaacgtctcaaattag

SEQ ID NO: 72241 - DNA, 18 bp, Artificial Sequence
  Synthetic DNA
taaaacgtctcacatcag

SEQ ID NO: 72242 - DNA, 18 bp, Artificial Sequence
  Synthetic DNA
taaaacgtctgattattg

SEQ ID NO: 72243 - DNA, 18 bp, Artificial Sequence
  Synthetic DNA
taaaactacacacaacag

SEQ ID NO: 72244 - DNA, 18 bp, Artificial Sequence
  Synthetic DNA
taaaatgatacactttag

SEQ ID NO: 72245 - DNA, 18 bp, Artificial Sequence
  Synthetic DNA
taaagcctctcattatag

SEQ ID NO: 72246 - DNA, 18 bp, Artificial Sequence
  Synthetic DNA
taaagctaatcactattg

SEQ ID NO: 72247 - DNA, 18 bp, Artificial Sequence
  Synthetic DNA
taaaggtgttcactatag

SEQ ID NO: 72248 - DNA, 18 bp, Artificial Sequence
  Synthetic DNA
taaatcgtcttactattg

SEQ ID NO: 72249 - DNA, 18 bp, Artificial Sequence
  Synthetic DNA
taaattgacacactaaag

SEQ ID NO: 72250 - DNA, 18 bp, Artificial Sequence
  Synthetic DNA
taaatttactcactaaag

SEQ ID NO: 72251 - DNA, 18 bp, Artificial Sequence
  Synthetic DNA
taacacaacccactgaag

SEQ ID NO: 72252 - DNA, 18 bp, Artificial Sequence
  Synthetic DNA
taacacctcacagtcaag

SEQ ID NO: 72253 - DNA, 18 bp, Artificial Sequence
  Synthetic DNA
taacacgattaacttaag

SEQ ID NO: 72254 - DNA, 18 bp, Artificial Sequence
  Synthetic DNA
taacactactcagaaaag

SEQ ID NO: 72255 - DNA, 18 bp, Artificial Sequence
  Synthetic DNA
taacatgactttcaatag

SEQ ID NO: 72256 - DNA, 18 bp, Artificial Sequence
  Synthetic DNA
taacgcgaaacatcatag

SEQ ID NO: 72257 - DNA, 18 bp, Artificial Sequence
  Synthetic DNA
taactcgacacacttaag

SEQ ID NO: 72258 - DNA, 18 bp, Artificial Sequence
  Synthetic DNA
taactcgcctccttatag

SEQ ID NO: 72259 - DNA, 18 bp, Artificial Sequence
  Synthetic DNA
taagttgacacactctag

SEQ ID NO: 72260 - DNA, 18 bp, Artificial Sequence
  Synthetic DNA
taataaaattctcttaag

SEQ ID NO: 72261 - DNA, 18 bp, Artificial Sequence
  Synthetic DNA
taataaatctctcgatag

SEQ ID NO: 72262 - DNA, 18 bp, Artificial Sequence
  Synthetic DNA
taatacaacacgctaatg

SEQ ID NO: 72263 - DNA, 18 bp, Artificial Sequence
  Synthetic DNA
taatacatcaaactgaag

SEQ ID NO: 72264 - DNA, 18 bp, Artificial Sequence
  Synthetic DNA
taataccacccatttgag

SEQ ID NO: 72265 - DNA, 18 bp, Artificial Sequence
  Synthetic DNA
taataccactcaaagatg

SEQ ID NO: 72266 - DNA, 18 bp, Artificial Sequence
  Synthetic DNA
taataccagactctaaag

SEQ ID NO: 72267 - DNA, 18 bp, Artificial Sequence
  Synthetic DNA
taatacgacatacatatg

SEQ ID NO: 72268 - DNA, 18 bp, Artificial Sequence
  Synthetic DNA
taatacgacctagcaaag

SEQ ID NO: 72269 - DNA, 18 bp, Artificial Sequence
  Synthetic DNA
taatacgactttataatg

SEQ ID NO: 72270 - DNA, 18 bp, Artificial Sequence
  Synthetic DNA
taatacgcttctctttcg

SEQ ID NO: 72271 - DNA, 18 bp, Artificial Sequence
  Synthetic DNA
taatacggcactcaaaag

SEQ ID NO: 72272 - DNA, 18 bp, Artificial Sequence
  Synthetic DNA
taatacggcccatataag

SEQ ID NO: 72273 - DNA, 18 bp, Artificial Sequence
  Synthetic DNA
taatacggctgccaattg

SEQ ID NO: 72274 - DNA, 18 bp, Artificial Sequence
  Synthetic DNA
taatacgtccacatactg

SEQ ID NO: 72275 - DNA, 18 bp, Artificial Sequence
  Synthetic DNA
taatacgtctcattcatg

SEQ ID NO: 72276 - DNA, 18 bp, Artificial Sequence
  Synthetic DNA
taatacgttccactccag

SEQ ID NO: 72277 - DNA, 18 bp, Artificial Sequence
  Synthetic DNA
taatacgtttccataaag

SEQ ID NO: 72278 - DNA, 18 bp, Artificial Sequence
  Synthetic DNA
taatactactaaattacg

SEQ ID NO: 72279 - DNA, 18 bp, Artificial Sequence
  Synthetic DNA
taatactactcacctatg

SEQ ID NO: 72280 - DNA, 18 bp, Artificial Sequence
  Synthetic DNA
taatagcacacacttaag

SEQ ID NO: 72281 - DNA, 18 bp, Artificial Sequence
  Synthetic DNA
taataggattttctaaag

SEQ ID NO: 72282 - DNA, 18 bp, Artificial Sequence
  Synthetic DNA
taataggtctttctaaag

SEQ ID NO: 72283 - DNA, 18 bp, Artificial Sequence
  Synthetic DNA
taatatcaaacactattg

SEQ ID NO: 72284 - DNA, 18 bp, Artificial Sequence
  Synthetic DNA
taatatgactattaatag

SEQ ID NO: 72285 - DNA, 18 bp, Artificial Sequence
  Synthetic DNA
taatatgatacattattg

SEQ ID NO: 72286 - DNA, 18 bp, Artificial Sequence
  Synthetic DNA
taatatgtctccctgaag

SEQ ID NO: 72287 - DNA, 18 bp, Artificial Sequence
  Synthetic DNA
taatatgtctctgtattg

SEQ ID NO: 72288 - DNA, 18 bp, Artificial Sequence
  Synthetic DNA
taatccatcacactattg

SEQ ID NO: 72289 - DNA, 18 bp, Artificial Sequence
  Synthetic DNA
taatccgactttgtagtg

SEQ ID NO: 72290 - DNA, 18 bp, Artificial Sequence
  Synthetic DNA
taatccgtctcatttttg

SEQ ID NO: 72291 - DNA, 18 bp, Artificial Sequence
  Synthetic DNA
taatcctacactctttag

SEQ ID NO: 72292 - DNA, 18 bp, Artificial Sequence
  Synthetic DNA
taatcttactctctctag

SEQ ID NO: 72293 - DNA, 18 bp, Artificial Sequence
  Synthetic DNA
taatgacactcactacgg

SEQ ID NO: 72294 - DNA, 18 bp, Artificial Sequence
  Synthetic DNA
taatgcaacactctaaag

SEQ ID NO: 72295 - DNA, 18 bp, Artificial Sequence
  Synthetic DNA
taattattctcaatatag

SEQ ID NO: 72296 - DNA, 18 bp, Artificial Sequence
  Synthetic DNA
taattcgaatctctaatg

SEQ ID NO: 72297 - DNA, 18 bp, Artificial Sequence
  Synthetic DNA
taattcgagttaaaattg

SEQ ID NO: 72298 - DNA, 18 bp, Artificial Sequence
  Synthetic DNA
taattcggttctctactg

SEQ ID NO: 72299 - DNA, 18 bp, Artificial Sequence
  Synthetic DNA
taattcgtctcaacacag

SEQ ID NO: 72300 - DNA, 18 bp, Artificial Sequence
  Synthetic DNA
taatttaattcacttaag

SEQ ID NO: 72301 - DNA, 18 bp, Artificial Sequence
  Synthetic DNA
taatttgactgatgaaag

SEQ ID NO: 72302 - DNA, 18 bp, Artificial Sequence
  Synthetic DNA
taatttgcatcacaatag

SEQ ID NO: 72303 - DNA, 18 bp, Artificial Sequence
  Synthetic DNA
taatttggctctctctag

SEQ ID NO: 72304 - DNA, 18 bp, Artificial Sequence
  Synthetic DNA
taatttgtcacacaatag

SEQ ID NO: 72305 - DNA, 18 bp, Artificial Sequence
  Synthetic DNA
tacaacgtctcaatacag

SEQ ID NO: 72306 - DNA, 18 bp, Artificial Sequence
  Synthetic DNA
taccacggctcttaatag

SEQ ID NO: 72307 - DNA, 18 bp, Artificial Sequence
  Synthetic DNA
tactacgtctctatttag

SEQ ID NO: 72308 - DNA, 18 bp, Artificial Sequence
  Synthetic DNA
tacttcgagacagtttag

SEQ ID NO: 72309 - DNA, 18 bp, Artificial Sequence
  Synthetic DNA
tagaacgtctcacattag

SEQ ID NO: 72310 - DNA, 18 bp, Artificial Sequence
  Synthetic DNA
tagcacgtctcacattag

SEQ ID NO: 72311 - DNA, 18 bp, Artificial Sequence
  Synthetic DNA
tagtaaaactcaacatag

SEQ ID NO: 72312 - DNA, 18 bp, Artificial Sequence
  Synthetic DNA
tagtacgagacattattg

SEQ ID NO: 72313 - DNA, 18 bp, Artificial Sequence
  Synthetic DNA
tagtacttatccacatag

SEQ ID NO: 72314 - DNA, 18 bp, Artificial Sequence
  Synthetic DNA
tagtatgacaaaaaatag

SEQ ID NO: 72315 - DNA, 18 bp, Artificial Sequence
  Synthetic DNA
tataacgacgcactcttg

SEQ ID NO: 72316 - DNA, 18 bp, Artificial Sequence
  Synthetic DNA
tataacggctgactattg

SEQ ID NO: 72317 - DNA, 18 bp, Artificial Sequence
  Synthetic DNA
tataacgtctcacgattg

SEQ ID NO: 72318 - DNA, 18 bp, Artificial Sequence
  Synthetic DNA
tataacgttgcactctag

SEQ ID NO: 72319 - DNA, 18 bp, Artificial Sequence
  Synthetic DNA
tataatgactctctatcg

SEQ ID NO: 72320 - DNA, 18 bp, Artificial Sequence
  Synthetic DNA
tataccgactaacagaag

SEQ ID NO: 72321 - DNA, 18 bp, Artificial Sequence
  Synthetic DNA
tatatcgactcacaaagg

SEQ ID NO: 72322 - DNA, 18 bp, Artificial Sequence
  Synthetic DNA
tatatcgactctctttag

SEQ ID NO: 72323 - DNA, 18 bp, Artificial Sequence
  Synthetic DNA
tatcaccactctctttag

SEQ ID NO: 72324 - DNA, 18 bp, Artificial Sequence
  Synthetic DNA
tatcacctctcactttag

SEQ ID NO: 72325 - DNA, 18 bp, Artificial Sequence
  Synthetic DNA
tatcacgactctcatttg

SEQ ID NO: 72326 - DNA, 18 bp, Artificial Sequence
  Synthetic DNA
tattaagaataaccaatg

SEQ ID NO: 72327 - DNA, 18 bp, Artificial Sequence
  Synthetic DNA
tattaatcctcagcatag

SEQ ID NO: 72328 - DNA, 18 bp, Artificial Sequence
  Synthetic DNA
tattacctttcactgtag

SEQ ID NO: 72329 - DNA, 18 bp, Artificial Sequence
  Synthetic DNA
tattacgaaatacaatag

SEQ ID NO: 72330 - DNA, 18 bp, Artificial Sequence
  Synthetic DNA
tattacgaactgctattg

SEQ ID NO: 72331 - DNA, 18 bp, Artificial Sequence
  Synthetic DNA
tattacgaataacaatcg

SEQ ID NO: 72332 - DNA, 18 bp, Artificial Sequence
  Synthetic DNA
tattacgtcacacttaag

SEQ ID NO: 72333 - DNA, 18 bp, Artificial Sequence
  Synthetic DNA
tattacgtctttctattg

SEQ ID NO: 72334 - DNA, 18 bp, Artificial Sequence
  Synthetic DNA
tattactacacgatatag

SEQ ID NO: 72335 - DNA, 18 bp, Artificial Sequence
  Synthetic DNA
tattactactcacacaag

SEQ ID NO: 72336 - DNA, 18 bp, Artificial Sequence
  Synthetic DNA
tattacttctcactaacg

SEQ ID NO: 72337 - DNA, 18 bp, Artificial Sequence
  Synthetic DNA
tattagggctcgctcaag

SEQ ID NO: 72338 - DNA, 18 bp, Artificial Sequence
  Synthetic DNA
tattaggtctcactgttg

SEQ ID NO: 72339 - DNA, 18 bp, Artificial Sequence
  Synthetic DNA
tattatgactcgttgtag

SEQ ID NO: 72340 - DNA, 18 bp, Artificial Sequence
  Synthetic DNA
tattatgtctcaacatag

SEQ ID NO: 72341 - DNA, 18 bp, Artificial Sequence
  Synthetic DNA
tattatgtcttactgtag

SEQ ID NO: 72342 - DNA, 18 bp, Artificial Sequence
  Synthetic DNA
tattattaattactatag

SEQ ID NO: 72343 - DNA, 18 bp, Artificial Sequence
  Synthetic DNA
tattattgttctcgatag

SEQ ID NO: 72344 - DNA, 18 bp, Artificial Sequence
  Synthetic DNA
tattcctcctcacaaaag

SEQ ID NO: 72345 - DNA, 18 bp, Artificial Sequence
  Synthetic DNA
tattctgaatctctaaag

SEQ ID NO: 72346 - DNA, 18 bp, Artificial Sequence
  Synthetic DNA
tatttcgacacgctattg

SEQ ID NO: 72347 - DNA, 18 bp, Artificial Sequence
  Synthetic DNA
tatttcgacttacaaatg

SEQ ID NO: 72348 - DNA, 18 bp, Artificial Sequence
  Synthetic DNA
tatttctaaacactatag

SEQ ID NO: 72349 - DNA, 18 bp, Artificial Sequence
  Synthetic DNA
tatttctactttctatag

SEQ ID NO: 72350 - DNA, 18 bp, Artificial Sequence
  Synthetic DNA
tcaatagactcacaatag

SEQ ID NO: 72351 - DNA, 18 bp, Artificial Sequence
  Synthetic DNA
tcaattgactctcaatag

SEQ ID NO: 72352 - DNA, 18 bp, Artificial Sequence
  Synthetic DNA
tcacacgtctcattctag

SEQ ID NO: 72353 - DNA, 18 bp, Artificial Sequence
  Synthetic DNA
tcatacaactccgtagtg

SEQ ID NO: 72354 - DNA, 18 bp, Artificial Sequence
  Synthetic DNA
tcatacgactcccaaatg

SEQ ID NO: 72355 - DNA, 18 bp, Artificial Sequence
  Synthetic DNA
tcatattacacactaaag

SEQ ID NO: 72356 - DNA, 18 bp, Artificial Sequence
  Synthetic DNA
tcattcgactcgcaatcg

SEQ ID NO: 72357 - DNA, 18 bp, Artificial Sequence
  Synthetic DNA
tcattcgatacactagag

SEQ ID NO: 72358 - DNA, 18 bp, Artificial Sequence
  Synthetic DNA
tcctccgattcaataaag

SEQ ID NO: 72359 - DNA, 18 bp, Artificial Sequence
  Synthetic DNA
tcgtatgagtgacaatag

SEQ ID NO: 72360 - DNA, 18 bp, Artificial Sequence
  Synthetic DNA
tcttacgcttcaatattg

SEQ ID NO: 72361 - DNA, 18 bp, Artificial Sequence
  Synthetic DNA
tcttgcgactcgctaaag

SEQ ID NO: 72362 - DNA, 18 bp, Artificial Sequence
  Synthetic DNA
tgaaacggctcgctacag

SEQ ID NO: 72363 - DNA, 18 bp, Artificial Sequence
  Synthetic DNA
tgaattgacacacaatag

SEQ ID NO: 72364 - DNA, 18 bp, Artificial Sequence
  Synthetic DNA
tgactcgactaacgctag

SEQ ID NO: 72365 - DNA, 18 bp, Artificial Sequence
  Synthetic DNA
tgatacgtctcgctactg

SEQ ID NO: 72366 - DNA, 18 bp, Artificial Sequence
  Synthetic DNA
tgatacgttgcactttag

SEQ ID NO: 72367 - DNA, 18 bp, Artificial Sequence
  Synthetic DNA
tgatactccttactaatg

SEQ ID NO: 72368 - DNA, 18 bp, Artificial Sequence
  Synthetic DNA
tgatgcgtttctcaatgg

SEQ ID NO: 72369 - DNA, 18 bp, Artificial Sequence
  Synthetic DNA
tgattcggcttttttaag

SEQ ID NO: 72370 - DNA, 18 bp, Artificial Sequence
  Synthetic DNA
tgattcgtctctatatag

SEQ ID NO: 72371 - DNA, 18 bp, Artificial Sequence
  Synthetic DNA
tgctacgatttattaatg

SEQ ID NO: 72372 - DNA, 18 bp, Artificial Sequence
  Synthetic DNA
tggcaagactcgcaaaag

SEQ ID NO: 72373 - DNA, 18 bp, Artificial Sequence
  Synthetic DNA
tggtacatttcactagag

SEQ ID NO: 72374 - DNA, 18 bp, Artificial Sequence
  Synthetic DNA
tgttacgtctctctcaag

SEQ ID NO: 72375 - DNA, 18 bp, Artificial Sequence
  Synthetic DNA
tgttacgtctctctctag

SEQ ID NO: 72376 - DNA, 18 bp, Artificial Sequence
  Synthetic DNA
ttaaacgacgtcctatag

SEQ ID NO: 72377 - DNA, 18 bp, Artificial Sequence
  Synthetic DNA
ttaacggactaactatag

SEQ ID NO: 72378 - DNA, 18 bp, Artificial Sequence
  Synthetic DNA
ttaagggactcaccatag

SEQ ID NO: 72379 - DNA, 18 bp, Artificial Sequence
  Synthetic DNA
ttacaagactctctaaag

SEQ ID NO: 72380 - DNA, 18 bp, Artificial Sequence
  Synthetic DNA
ttaccagactgactctag

SEQ ID NO: 72381 - DNA, 18 bp, Artificial Sequence
  Synthetic DNA
ttagtcgattcgctatag

SEQ ID NO: 72382 - DNA, 18 bp, Artificial Sequence
  Synthetic DNA
ttataagtcttactattg

SEQ ID NO: 72383 - DNA, 18 bp, Artificial Sequence
  Synthetic DNA
ttatacaactatccatag

SEQ ID NO: 72384 - DNA, 18 bp, Artificial Sequence
  Synthetic DNA
ttatacatctaacaatag

SEQ ID NO: 72385 - DNA, 18 bp, Artificial Sequence
  Synthetic DNA
ttatacgtatcactaatg

SEQ ID NO: 72386 - DNA, 18 bp, Artificial Sequence
  Synthetic DNA
ttatacgtcacacttatg

SEQ ID NO: 72387 - DNA, 18 bp, Artificial Sequence
  Synthetic DNA
ttatacgtcactctattg

SEQ ID NO: 72388 - DNA, 18 bp, Artificial Sequence
  Synthetic DNA
ttatacgttttactaaag

SEQ ID NO: 72389 - DNA, 18 bp, Artificial Sequence
  Synthetic DNA
ttatactacttactaatg

SEQ ID NO: 72390 - DNA, 18 bp, Artificial Sequence
  Synthetic DNA
ttatccaaatcactaaag

SEQ ID NO: 72391 - DNA, 18 bp, Artificial Sequence
  Synthetic DNA
ttatgcatttcactatag

SEQ ID NO: 72392 - DNA, 18 bp, Artificial Sequence
  Synthetic DNA
ttatgcgactctacatag

SEQ ID NO: 72393 - DNA, 18 bp, Artificial Sequence
  Synthetic DNA
ttatgcgtctcgcaatag

SEQ ID NO: 72394 - DNA, 18 bp, Artificial Sequence
  Synthetic DNA
ttattcaactcgcaatag

SEQ ID NO: 72395 - DNA, 18 bp, Artificial Sequence
  Synthetic DNA
ttatttgtctcattccag

SEQ ID NO: 72396 - DNA, 18 bp, Artificial Sequence
  Synthetic DNA
ttcaacgacactctatag

SEQ ID NO: 72397 - DNA, 18 bp, Artificial Sequence
  Synthetic DNA
ttgaacgtctctctatag

SEQ ID NO: 72398 - DNA, 18 bp, Artificial Sequence
  Synthetic DNA
tttaatgtctcactatag

SEQ ID NO: 72399 - DNA, 18 bp, Artificial Sequence
  Synthetic DNA
tttcacgacacactagag

SEQ ID NO: 72400 - DNA, 18 bp, Artificial Sequence
  Synthetic DNA
ttttacgactcatcaacg

SEQ ID NO: 72401 - DNA, 18 bp, Artificial Sequence
  Synthetic DNA
ttttacgactttctattg

SEQ ID NO: 72402 - DNA, 18 bp, Artificial Sequence
  Synthetic DNA
ttttccaacccactatag

SEQ ID NO: 72403 - DNA, 18 bp, Artificial Sequence
  Synthetic DNA
tttttcgacctattttag

SEQ ID NO: 72404 - DNA, 18 bp, Artificial Sequence
  Synthetic DNA
tttttcgtctcacaattg

SEQ ID NO: 72405 - DNA, 18 bp, Artificial Sequence
  Synthetic DNA
tttttcgtgtaactatag

SEQ ID NO: 72406 - DNA, 18 bp, Artificial Sequence
  Synthetic DNA
ttatacgtcacactaatg

SEQ ID NO: 72407 - DNA, 18 bp, Artificial Sequence
  Synthetic DNA
taatacgactttcgcatg

SEQ ID NO: 72408 - DNA, 18 bp, Artificial Sequence
  Synthetic DNA
aaaaacgtctcagaatag

SEQ ID NO: 72409 - DNA, 18 bp, Artificial Sequence
  Synthetic DNA
aaaatcgactcacttatg

SEQ ID NO: 72410 - DNA, 18 bp, Artificial Sequence
  Synthetic DNA
aaaatcgtctcactttag

SEQ ID NO: 72411 - DNA, 18 bp, Artificial Sequence
  Synthetic DNA
aaacacgtctctctagag

SEQ ID NO: 72412 - DNA, 18 bp, Artificial Sequence
  Synthetic DNA
aaacatgactcaataatg

SEQ ID NO: 72413 - DNA, 18 bp, Artificial Sequence
  Synthetic DNA
aaataccattctttatag

SEQ ID NO: 72414 - DNA, 18 bp, Artificial Sequence
  Synthetic DNA
aaatacgacacacttatg

SEQ ID NO: 72415 - DNA, 18 bp, Artificial Sequence
  Synthetic DNA
aaatacgactctcatttg

SEQ ID NO: 72416 - DNA, 18 bp, Artificial Sequence
  Synthetic DNA
aaatacgatactctttag

SEQ ID NO: 72417 - DNA, 18 bp, Artificial Sequence
  Synthetic DNA
aaatacgcgtcacaaaag

SEQ ID NO: 72418 - DNA, 18 bp, Artificial Sequence
  Synthetic DNA
aaatacgtctcattactg

SEQ ID NO: 72419 - DNA, 18 bp, Artificial Sequence
  Synthetic DNA
aaatactactcacataag

SEQ ID NO: 72420 - DNA, 18 bp, Artificial Sequence
  Synthetic DNA
aaatactcctcacattag

SEQ ID NO: 72421 - DNA, 18 bp, Artificial Sequence
  Synthetic DNA
aaatactcctcacttttg

SEQ ID NO: 72422 - DNA, 18 bp, Artificial Sequence
  Synthetic DNA
aaatattactcaatttag

SEQ ID NO: 72423 - DNA, 18 bp, Artificial Sequence
  Synthetic DNA
aaatccgactctcgtcag

SEQ ID NO: 72424 - DNA, 18 bp, Artificial Sequence
  Synthetic DNA
aaatcggactgtctatag

SEQ ID NO: 72425 - DNA, 18 bp, Artificial Sequence
  Synthetic DNA
aaattcgactttcaatag

SEQ ID NO: 72426 - DNA, 18 bp, Artificial Sequence
  Synthetic DNA
aaatttgaatcacttttg

SEQ ID NO: 72427 - DNA, 18 bp, Artificial Sequence
  Synthetic DNA
aacttggactcacataag

SEQ ID NO: 72428 - DNA, 18 bp, Artificial Sequence
  Synthetic DNA
aagaatgactcaatatag

SEQ ID NO: 72429 - DNA, 18 bp, Artificial Sequence
  Synthetic DNA
aataccgacccactatcg

SEQ ID NO: 72430 - DNA, 18 bp, Artificial Sequence
  Synthetic DNA
aatatcgattccctaaag

SEQ ID NO: 72431 - DNA, 18 bp, Artificial Sequence
  Synthetic DNA
aattacaactcgcaatag

SEQ ID NO: 72432 - DNA, 18 bp, Artificial Sequence
  Synthetic DNA
aattacgatacacaattg

SEQ ID NO: 72433 - DNA, 18 bp, Artificial Sequence
  Synthetic DNA
aatttcaactcagtttag

SEQ ID NO: 72434 - DNA, 18 bp, Artificial Sequence
  Synthetic DNA
aatttcgtcttactaaag

SEQ ID NO: 72435 - DNA, 18 bp, Artificial Sequence
  Synthetic DNA
acatcccattcacttaag

SEQ ID NO: 72436 - DNA, 18 bp, Artificial Sequence
  Synthetic DNA
acattcaacacactatag

SEQ ID NO: 72437 - DNA, 18 bp, Artificial Sequence
  Synthetic DNA
agagactacacactatag

SEQ ID NO: 72438 - DNA, 18 bp, Artificial Sequence
  Synthetic DNA
agatatgccacactttag

SEQ ID NO: 72439 - DNA, 18 bp, Artificial Sequence
  Synthetic DNA
atacaccacattctatcg

SEQ ID NO: 72440 - DNA, 18 bp, Artificial Sequence
  Synthetic DNA
atataatactcactctag

SEQ ID NO: 72441 - DNA, 18 bp, Artificial Sequence
  Synthetic DNA
atatacgacactctgtag

SEQ ID NO: 72442 - DNA, 18 bp, Artificial Sequence
  Synthetic DNA
atatacgtctctctctag

SEQ ID NO: 72443 - DNA, 18 bp, Artificial Sequence
  Synthetic DNA
atatacgtcttacttttg

SEQ ID NO: 72444 - DNA, 18 bp, Artificial Sequence
  Synthetic DNA
atataggactaactattg

SEQ ID NO: 72445 - DNA, 18 bp, Artificial Sequence
  Synthetic DNA
atattcaactcactattg

SEQ ID NO: 72446 - DNA, 18 bp, Artificial Sequence
  Synthetic DNA
atattcgactccctctag

SEQ ID NO: 72447 - DNA, 18 bp, Artificial Sequence
  Synthetic DNA
atgtacttctcactatag

SEQ ID NO: 72448 - DNA, 18 bp, Artificial Sequence
  Synthetic DNA
attaaatactcactttag

SEQ ID NO: 72449 - DNA, 18 bp, Artificial Sequence
  Synthetic DNA
atttacaactcacaatag

SEQ ID NO: 72450 - DNA, 18 bp, Artificial Sequence
  Synthetic DNA
caaatcggctatcaaagg

SEQ ID NO: 72451 - DNA, 18 bp, Artificial Sequence
  Synthetic DNA
caatacgactctcttatg

SEQ ID NO: 72452 - DNA, 18 bp, Artificial Sequence
  Synthetic DNA
caattcgattaacatcag

SEQ ID NO: 72453 - DNA, 18 bp, Artificial Sequence
  Synthetic DNA
cactactacttaatagag

SEQ ID NO: 72454 - DNA, 18 bp, Artificial Sequence
  Synthetic DNA
ccaatcgttacactatag

SEQ ID NO: 72455 - DNA, 18 bp, Artificial Sequence
  Synthetic DNA
ccataagactcactcaag

SEQ ID NO: 72456 - DNA, 18 bp, Artificial Sequence
  Synthetic DNA
ccatacgtatgactgcag

SEQ ID NO: 72457 - DNA, 18 bp, Artificial Sequence
  Synthetic DNA
ctaaacgacacactttag

SEQ ID NO: 72458 - DNA, 18 bp, Artificial Sequence
  Synthetic DNA
ctaaacgactcactcaag

SEQ ID NO: 72459 - DNA, 18 bp, Artificial Sequence
  Synthetic DNA
ctatacgtctctctttag

SEQ ID NO: 72460 - DNA, 18 bp, Artificial Sequence
  Synthetic DNA
ctatacgtttctctaaag

SEQ ID NO: 72461 - DNA, 18 bp, Artificial Sequence
  Synthetic DNA
gacaaagactcaatagag

SEQ ID NO: 72462 - DNA, 18 bp, Artificial Sequence
  Synthetic DNA
gattaggatacactatag

SEQ ID NO: 72463 - DNA, 18 bp, Artificial Sequence
  Synthetic DNA
taaaaaaacttacaatag

SEQ ID NO: 72464 - DNA, 18 bp, Artificial Sequence
  Synthetic DNA
taaaaagacacaccacag

SEQ ID NO: 72465 - DNA, 18 bp, Artificial Sequence
  Synthetic DNA
taaaaagtcttaccatag

SEQ ID NO: 72466 - DNA, 18 bp, Artificial Sequence
  Synthetic DNA
taaaacaaatctatatag

SEQ ID NO: 72467 - DNA, 18 bp, Artificial Sequence
  Synthetic DNA
taaaaccactttctttag

SEQ ID NO: 72468 - DNA, 18 bp, Artificial Sequence
  Synthetic DNA
taaaacgaaacacattag

SEQ ID NO: 72469 - DNA, 18 bp, Artificial Sequence
  Synthetic DNA
taaaattgctcactaatg

SEQ ID NO: 72470 - DNA, 18 bp, Artificial Sequence
  Synthetic DNA
taaactgactctctttag

SEQ ID NO: 72471 - DNA, 18 bp, Artificial Sequence
  Synthetic DNA
taaatgcgctcactgtag

SEQ ID NO: 72472 - DNA, 18 bp, Artificial Sequence
  Synthetic DNA
taacaagacttcctaatg

SEQ ID NO: 72473 - DNA, 18 bp, Artificial Sequence
  Synthetic DNA
taacacgacaaggtattg

SEQ ID NO: 72474 - DNA, 18 bp, Artificial Sequence
  Synthetic DNA
taacacgtttctcaatag

SEQ ID NO: 72475 - DNA, 18 bp, Artificial Sequence
  Synthetic DNA
taacatgaaacactattg

SEQ ID NO: 72476 - DNA, 18 bp, Artificial Sequence
  Synthetic DNA
taataacaatctctttag

SEQ ID NO: 72477 - DNA, 18 bp, Artificial Sequence
  Synthetic DNA
taataagactcatttatg

SEQ ID NO: 72478 - DNA, 18 bp, Artificial Sequence
  Synthetic DNA
taataagatttaatctag

SEQ ID NO: 72479 - DNA, 18 bp, Artificial Sequence
  Synthetic DNA
taataatatacactattg

SEQ ID NO: 72480 - DNA, 18 bp, Artificial Sequence
  Synthetic DNA
taatacaacacaattttg

SEQ ID NO: 72481 - DNA, 18 bp, Artificial Sequence
  Synthetic DNA
taatacaagtcacagaag

SEQ ID NO: 72482 - DNA, 18 bp, Artificial Sequence
  Synthetic DNA
taatacattacactatcg

SEQ ID NO: 72483 - DNA, 18 bp, Artificial Sequence
  Synthetic DNA
taatacgaaatacaattg

SEQ ID NO: 72484 - DNA, 18 bp, Artificial Sequence
  Synthetic DNA
taatacgaaatattattg

SEQ ID NO: 72485 - DNA, 18 bp, Artificial Sequence
  Synthetic DNA
taatacgacacgtattag

SEQ ID NO: 72486 - DNA, 18 bp, Artificial Sequence
  Synthetic DNA
taatacgacttcttaatg

SEQ ID NO: 72487 - DNA, 18 bp, Artificial Sequence
  Synthetic DNA
taatacgagactcattag

SEQ ID NO: 72488 - DNA, 18 bp, Artificial Sequence
  Synthetic DNA
taatacgtctgtcttttg

SEQ ID NO: 72489 - DNA, 18 bp, Artificial Sequence
  Synthetic DNA
taatacttgtcaataaag

SEQ ID NO: 72490 - DNA, 18 bp, Artificial Sequence
  Synthetic DNA
taataggggatgctaaag

SEQ ID NO: 72491 - DNA, 18 bp, Artificial Sequence
  Synthetic DNA
taatataactccctaatg

SEQ ID NO: 72492 - DNA, 18 bp, Artificial Sequence
  Synthetic DNA
taatatgaaacacgttag

SEQ ID NO: 72493 - DNA, 18 bp, Artificial Sequence
  Synthetic DNA
taatatgacttaaaattg

SEQ ID NO: 72494 - DNA, 18 bp, Artificial Sequence
  Synthetic DNA
taatatgattcaattaag

SEQ ID NO: 72495 - DNA, 18 bp, Artificial Sequence
  Synthetic DNA
taatatgtctcatttaag

SEQ ID NO: 72496 - DNA, 18 bp, Artificial Sequence
  Synthetic DNA
taatatgtctctcgaaag

SEQ ID NO: 72497 - DNA, 18 bp, Artificial Sequence
  Synthetic DNA
taatctgactcacatgag

SEQ ID NO: 72498 - DNA, 18 bp, Artificial Sequence
  Synthetic DNA
taatgcgaacctcaatag

SEQ ID NO: 72499 - DNA, 18 bp, Artificial Sequence
  Synthetic DNA
taattcaaatcgctaaag

SEQ ID NO: 72500 - DNA, 18 bp, Artificial Sequence
  Synthetic DNA
taattcaattcattaaag

SEQ ID NO: 72501 - DNA, 18 bp, Artificial Sequence
  Synthetic DNA
taattcgaatctttattg

SEQ ID NO: 72502 - DNA, 18 bp, Artificial Sequence
  Synthetic DNA
taattcgatatgctattg

SEQ ID NO: 72503 - DNA, 18 bp, Artificial Sequence
  Synthetic DNA
taattcgcaacacaattg

SEQ ID NO: 72504 - DNA, 18 bp, Artificial Sequence
  Synthetic DNA
taattcgtctctctccag

SEQ ID NO: 72505 - DNA, 18 bp, Artificial Sequence
  Synthetic DNA
taattcgtgtaacaatag

SEQ ID NO: 72506 - DNA, 18 bp, Artificial Sequence
  Synthetic DNA
taattctactcatattag

SEQ ID NO: 72507 - DNA, 18 bp, Artificial Sequence
  Synthetic DNA
taattctgctcactaatg

SEQ ID NO: 72508 - DNA, 18 bp, Artificial Sequence
  Synthetic DNA
taattgatctcactagtg

SEQ ID NO: 72509 - DNA, 18 bp, Artificial Sequence
  Synthetic DNA
taatttggcacactaaag

SEQ ID NO: 72510 - DNA, 18 bp, Artificial Sequence
  Synthetic DNA
tacatcgacccacactag

SEQ ID NO: 72511 - DNA, 18 bp, Artificial Sequence
  Synthetic DNA
tacgacaactctcactag

SEQ ID NO: 72512 - DNA, 18 bp, Artificial Sequence
  Synthetic DNA
tactaagagtctcaatag

SEQ ID NO: 72513 - DNA, 18 bp, Artificial Sequence
  Synthetic DNA
tactacgaaaccccatag

SEQ ID NO: 72514 - DNA, 18 bp, Artificial Sequence
  Synthetic DNA
tactacgtatcactcaag

SEQ ID NO: 72515 - DNA, 18 bp, Artificial Sequence
  Synthetic DNA
tactactactagctattg

SEQ ID NO: 72516 - DNA, 18 bp, Artificial Sequence
  Synthetic DNA
tacttcttctgactatag

SEQ ID NO: 72517 - DNA, 18 bp, Artificial Sequence
  Synthetic DNA
tagagagactcactaaag

SEQ ID NO: 72518 - DNA, 18 bp, Artificial Sequence
  Synthetic DNA
tagcacgattaactatcg

SEQ ID NO: 72519 - DNA, 18 bp, Artificial Sequence
  Synthetic DNA
tagtacagctcgaaatag

SEQ ID NO: 72520 - DNA, 18 bp, Artificial Sequence
  Synthetic DNA
tataaagactctctattg

SEQ ID NO: 72521 - DNA, 18 bp, Artificial Sequence
  Synthetic DNA
tataacgacacaatatcg

SEQ ID NO: 72522 - DNA, 18 bp, Artificial Sequence
  Synthetic DNA
tatagcgactcaataaag

SEQ ID NO: 72523 - DNA, 18 bp, Artificial Sequence
  Synthetic DNA
tatagcgtctcactattg

SEQ ID NO: 72524 - DNA, 18 bp, Artificial Sequence
  Synthetic DNA
tatatatactcactatag

SEQ ID NO: 72525 - DNA, 18 bp, Artificial Sequence
  Synthetic DNA
tatatcgacacactctag

SEQ ID NO: 72526 - DNA, 18 bp, Artificial Sequence
  Synthetic DNA
tatatcgactgtctttag

SEQ ID NO: 72527 - DNA, 18 bp, Artificial Sequence
  Synthetic DNA
tatcaccactcacaaaag

SEQ ID NO: 72528 - DNA, 18 bp, Artificial Sequence
  Synthetic DNA
tatcacgttacactttag

SEQ ID NO: 72529 - DNA, 18 bp, Artificial Sequence
  Synthetic DNA
tatcatgtctcattatag

SEQ ID NO: 72530 - DNA, 18 bp, Artificial Sequence
  Synthetic DNA
tatctccataccctatag

SEQ ID NO: 72531 - DNA, 18 bp, Artificial Sequence
  Synthetic DNA
tattacaactcgcattag

SEQ ID NO: 72532 - DNA, 18 bp, Artificial Sequence
  Synthetic DNA
tattacaactctttttag

SEQ ID NO: 72533 - DNA, 18 bp, Artificial Sequence
  Synthetic DNA
tattacacctcaatattg

SEQ ID NO: 72534 - DNA, 18 bp, Artificial Sequence
  Synthetic DNA
tattaccacacacagtag

SEQ ID NO: 72535 - DNA, 18 bp, Artificial Sequence
  Synthetic DNA
tattaccattgattatag

SEQ ID NO: 72536 - DNA, 18 bp, Artificial Sequence
  Synthetic DNA
tattacgaatctccaaag

SEQ ID NO: 72537 - DNA, 18 bp, Artificial Sequence
  Synthetic DNA
tattacgacataccaaag

SEQ ID NO: 72538 - DNA, 18 bp, Artificial Sequence
  Synthetic DNA
tattacgactagcttaag

SEQ ID NO: 72539 - DNA, 18 bp, Artificial Sequence
  Synthetic DNA
tattacgacttacggttg

SEQ ID NO: 72540 - DNA, 18 bp, Artificial Sequence
  Synthetic DNA
tattacgtctaaccttag

SEQ ID NO: 72541 - DNA, 18 bp, Artificial Sequence
  Synthetic DNA
tattacgtctaactcttg

SEQ ID NO: 72542 - DNA, 18 bp, Artificial Sequence
  Synthetic DNA
tattacgtttaactattg

SEQ ID NO: 72543 - DNA, 18 bp, Artificial Sequence
  Synthetic DNA
tattactacctacgatag

SEQ ID NO: 72544 - DNA, 18 bp, Artificial Sequence
  Synthetic DNA
tattactactgcttatcg

SEQ ID NO: 72545 - DNA, 18 bp, Artificial Sequence
  Synthetic DNA
tattactacttactaatg

SEQ ID NO: 72546 - DNA, 18 bp, Artificial Sequence
  Synthetic DNA
tattatcacacactaaag

SEQ ID NO: 72547 - DNA, 18 bp, Artificial Sequence
  Synthetic DNA
tattatgaatcacaattg

SEQ ID NO: 72548 - DNA, 18 bp, Artificial Sequence
  Synthetic DNA
tattatggctcattctag

SEQ ID NO: 72549 - DNA, 18 bp, Artificial Sequence
  Synthetic DNA
tattcacactccctttag

SEQ ID NO: 72550 - DNA, 18 bp, Artificial Sequence
  Synthetic DNA
tattcagtctcactagag

SEQ ID NO: 72551 - DNA, 18 bp, Artificial Sequence
  Synthetic DNA
tattccgacacaacatag

SEQ ID NO: 72552 - DNA, 18 bp, Artificial Sequence
  Synthetic DNA
tattccgcctcacttgag

SEQ ID NO: 72553 - DNA, 18 bp, Artificial Sequence
  Synthetic DNA
tattgcgacgttctattg

SEQ ID NO: 72554 - DNA, 18 bp, Artificial Sequence
  Synthetic DNA
tattgggactcactaatg

SEQ ID NO: 72555 - DNA, 18 bp, Artificial Sequence
  Synthetic DNA
tatttagtctcaatatag

SEQ ID NO: 72556 - DNA, 18 bp, Artificial Sequence
  Synthetic DNA
tatttcgattcgctagag

SEQ ID NO: 72557 - DNA, 18 bp, Artificial Sequence
  Synthetic DNA
tatttcgtctcacttaag

SEQ ID NO: 72558 - DNA, 18 bp, Artificial Sequence
  Synthetic DNA
tcataagaatcacaattg

SEQ ID NO: 72559 - DNA, 18 bp, Artificial Sequence
  Synthetic DNA
tcatacaactctttagag

SEQ ID NO: 72560 - DNA, 18 bp, Artificial Sequence
  Synthetic DNA
tcatacaattctctaaag

SEQ ID NO: 72561 - DNA, 18 bp, Artificial Sequence
  Synthetic DNA
tcatacgtctcgatattg

SEQ ID NO: 72562 - DNA, 18 bp, Artificial Sequence
  Synthetic DNA
tcatactactaaacaaag

SEQ ID NO: 72563 - DNA, 18 bp, Artificial Sequence
  Synthetic DNA
tcatatgacttattaaag

SEQ ID NO: 72564 - DNA, 18 bp, Artificial Sequence
  Synthetic DNA
tcatccgattcacattag

SEQ ID NO: 72565 - DNA, 18 bp, Artificial Sequence
  Synthetic DNA
tcattccaatcactaaag

SEQ ID NO: 72566 - DNA, 18 bp, Artificial Sequence
  Synthetic DNA
tcctacgacactctaaag

SEQ ID NO: 72567 - DNA, 18 bp, Artificial Sequence
  Synthetic DNA
tcctacgtctctctacag

SEQ ID NO: 72568 - DNA, 18 bp, Artificial Sequence
  Synthetic DNA
tctaacccctcacaatag

SEQ ID NO: 72569 - DNA, 18 bp, Artificial Sequence
  Synthetic DNA
tctaatgactcaatacag

SEQ ID NO: 72570 - DNA, 18 bp, Artificial Sequence
  Synthetic DNA
tcttacgacgcattaaag

SEQ ID NO: 72571 - DNA, 18 bp, Artificial Sequence
  Synthetic DNA
tgaatggactaactatag

SEQ ID NO: 72572 - DNA, 18 bp, Artificial Sequence
  Synthetic DNA
tgatacgacatactttcg

SEQ ID NO: 72573 - DNA, 18 bp, Artificial Sequence
  Synthetic DNA
tgatacgcccaacaatag

SEQ ID NO: 72574 - DNA, 18 bp, Artificial Sequence
  Synthetic DNA
tgatacgtatcgatattg

SEQ ID NO: 72575 - DNA, 18 bp, Artificial Sequence
  Synthetic DNA
tgatactactcatttaag

SEQ ID NO: 72576 - DNA, 18 bp, Artificial Sequence
  Synthetic DNA
tgatagagcacacaatag

SEQ ID NO: 72577 - DNA, 18 bp, Artificial Sequence
  Synthetic DNA
tgataggagtcactaatg

SEQ ID NO: 72578 - DNA, 18 bp, Artificial Sequence
  Synthetic DNA
tgattcgaatctatatag

SEQ ID NO: 72579 - DNA, 18 bp, Artificial Sequence
  Synthetic DNA
tgatttcaatcaatatag

SEQ ID NO: 72580 - DNA, 18 bp, Artificial Sequence
  Synthetic DNA
tgttacgactccttaacg

SEQ ID NO: 72581 - DNA, 18 bp, Artificial Sequence
  Synthetic DNA
ttaaacgattcaggatag

SEQ ID NO: 72582 - DNA, 18 bp, Artificial Sequence
  Synthetic DNA
ttaaacgcctcaataaag

SEQ ID NO: 72583 - DNA, 18 bp, Artificial Sequence
  Synthetic DNA
ttacacaactcgcttttg

SEQ ID NO: 72584 - DNA, 18 bp, Artificial Sequence
  Synthetic DNA
ttacacgacgctttattg

SEQ ID NO: 72585 - DNA, 18 bp, Artificial Sequence
  Synthetic DNA
ttaggcgtctaactaaag

SEQ ID NO: 72586 - DNA, 18 bp, Artificial Sequence
  Synthetic DNA
ttatacaattcagtaaag

SEQ ID NO: 72587 - DNA, 18 bp, Artificial Sequence
  Synthetic DNA
ttatacagctctctacag

SEQ ID NO: 72588 - DNA, 18 bp, Artificial Sequence
  Synthetic DNA
ttatacagttcactaaag

SEQ ID NO: 72589 - DNA, 18 bp, Artificial Sequence
  Synthetic DNA
ttatacatcacactatcg

SEQ ID NO: 72590 - DNA, 18 bp, Artificial Sequence
  Synthetic DNA
ttataccagccactgttg

SEQ ID NO: 72591 - DNA, 18 bp, Artificial Sequence
  Synthetic DNA
ttatacgaatagctaatg

SEQ ID NO: 72592 - DNA, 18 bp, Artificial Sequence
  Synthetic DNA
ttatacgatttaccttag

SEQ ID NO: 72593 - DNA, 18 bp, Artificial Sequence
  Synthetic DNA
ttatacggttctttatag

SEQ ID NO: 72594 - DNA, 18 bp, Artificial Sequence
  Synthetic DNA
ttatacgtctaattttag

SEQ ID NO: 72595 - DNA, 18 bp, Artificial Sequence
  Synthetic DNA
ttatactactcacaaatg

SEQ ID NO: 72596 - DNA, 18 bp, Artificial Sequence
  Synthetic DNA
ttatatttctcactattg

SEQ ID NO: 72597 - DNA, 18 bp, Artificial Sequence
  Synthetic DNA
ttatgccactggctatag

SEQ ID NO: 72598 - DNA, 18 bp, Artificial Sequence
  Synthetic DNA
ttattcgtatcactatcg

SEQ ID NO: 72599 - DNA, 18 bp, Artificial Sequence
  Synthetic DNA
ttattcgtctcacttaag

SEQ ID NO: 72600 - DNA, 18 bp, Artificial Sequence
  Synthetic DNA
ttgttcgattctctatag

SEQ ID NO: 72601 - DNA, 18 bp, Artificial Sequence
  Synthetic DNA
tttaacctttcactatag

SEQ ID NO: 72602 - DNA, 18 bp, Artificial Sequence
  Synthetic DNA
tttaacgtctcacaatag

SEQ ID NO: 72603 - DNA, 18 bp, Artificial Sequence
  Synthetic DNA
tttaatcactcactatag

SEQ ID NO: 72604 - DNA, 18 bp, Artificial Sequence
  Synthetic DNA
ttttacgactaacattag

SEQ ID NO: 72605 - DNA, 18 bp, Artificial Sequence
  Synthetic DNA
ttttacgattaactgtag

SEQ ID NO: 72606 - DNA, 18 bp, Artificial Sequence
  Synthetic DNA
ttttacgtcactctatag

SEQ ID NO: 72607 - DNA, 18 bp, Artificial Sequence
  Synthetic DNA
ttttgcgactcactcttg

SEQ ID NO: 72608 - DNA, 18 bp, Artificial Sequence
  Synthetic DNA
tttttcgactcacttttg

SEQ ID NO: 72609 - DNA, 18 bp, Artificial Sequence
  Synthetic DNA
tttttcgactcattttag

SEQ ID NO: 72610 - DNA, 18 bp, Artificial Sequence
  Synthetic DNA
taattcgacaaacaattg

SEQ ID NO: 72611 - DNA, 18 bp, Artificial Sequence
  Synthetic DNA
tcttactacactctatag

SEQ ID NO: 72612 - DNA, 18 bp, Artificial Sequence
  Synthetic DNA
aatttctactctctatag

SEQ ID NO: 72613 - DNA, 18 bp, Artificial Sequence
  Synthetic DNA
aaaaacgacacgctagag

SEQ ID NO: 72614 - DNA, 18 bp, Artificial Sequence
  Synthetic DNA
aaaaacgactctcttaag

SEQ ID NO: 72615 - DNA, 18 bp, Artificial Sequence
  Synthetic DNA
aaaaacgattttctatag

SEQ ID NO: 72616 - DNA, 18 bp, Artificial Sequence
  Synthetic DNA
aaaaacgtcacacaatag

SEQ ID NO: 72617 - DNA, 18 bp, Artificial Sequence
  Synthetic DNA
aaaatcgactatatatag

SEQ ID NO: 72618 - DNA, 18 bp, Artificial Sequence
  Synthetic DNA
aaacacgacccaatagag

SEQ ID NO: 72619 - DNA, 18 bp, Artificial Sequence
  Synthetic DNA
aaacacgtctctctattg

SEQ ID NO: 72620 - DNA, 18 bp, Artificial Sequence
  Synthetic DNA
aaatacatctctctaaag

SEQ ID NO: 72621 - DNA, 18 bp, Artificial Sequence
  Synthetic DNA
aaatacgactatcttaag

SEQ ID NO: 72622 - DNA, 18 bp, Artificial Sequence
  Synthetic DNA
aaatacgcctctcttttg

SEQ ID NO: 72623 - DNA, 18 bp, Artificial Sequence
  Synthetic DNA
aaatactactcgttttag

SEQ ID NO: 72624 - DNA, 18 bp, Artificial Sequence
  Synthetic DNA
aaatacttctcacttaag

SEQ ID NO: 72625 - DNA, 18 bp, Artificial Sequence
  Synthetic DNA
aaatatgacaatctatag

SEQ ID NO: 72626 - DNA, 18 bp, Artificial Sequence
  Synthetic DNA
aaatatgtctcaacctag

SEQ ID NO: 72627 - DNA, 18 bp, Artificial Sequence
  Synthetic DNA
aaattcaagattcaatag

SEQ ID NO: 72628 - DNA, 18 bp, Artificial Sequence
  Synthetic DNA
aataacgactcacttaag

SEQ ID NO: 72629 - DNA, 18 bp, Artificial Sequence
  Synthetic DNA
aataacgactgaatgtag

SEQ ID NO: 72630 - DNA, 18 bp, Artificial Sequence
  Synthetic DNA
aatcacgtctcactaaag

SEQ ID NO: 72631 - DNA, 18 bp, Artificial Sequence
  Synthetic DNA
aattacctctcacagtag

SEQ ID NO: 72632 - DNA, 18 bp, Artificial Sequence
  Synthetic DNA
aattactacacactattg

SEQ ID NO: 72633 - DNA, 18 bp, Artificial Sequence
  Synthetic DNA
aattgcgtctaacaatag

SEQ ID NO: 72634 - DNA, 18 bp, Artificial Sequence
  Synthetic DNA
acatacggctatctattg

SEQ ID NO: 72635 - DNA, 18 bp, Artificial Sequence
  Synthetic DNA
acatagtacccactttag

SEQ ID NO: 72636 - DNA, 18 bp, Artificial Sequence
  Synthetic DNA
ataaaccactcactttag

SEQ ID NO: 72637 - DNA, 18 bp, Artificial Sequence
  Synthetic DNA
ataaacgaaccactggag

SEQ ID NO: 72638 - DNA, 18 bp, Artificial Sequence
  Synthetic DNA
ataaacgactctctttag

SEQ ID NO: 72639 - DNA, 18 bp, Artificial Sequence
  Synthetic DNA
ataaaggactcattatag

SEQ ID NO: 72640 - DNA, 18 bp, Artificial Sequence
  Synthetic DNA
atacacgcctcacaatag

SEQ ID NO: 72641 - DNA, 18 bp, Artificial Sequence
  Synthetic DNA
atatacgacctactgtag

SEQ ID NO: 72642 - DNA, 18 bp, Artificial Sequence
  Synthetic DNA
atatacgtctaactattg

SEQ ID NO: 72643 - DNA, 18 bp, Artificial Sequence
  Synthetic DNA
atatacgtctcactcttg

SEQ ID NO: 72644 - DNA, 18 bp, Artificial Sequence
  Synthetic DNA
atatacttatcactatag

SEQ ID NO: 72645 - DNA, 18 bp, Artificial Sequence
  Synthetic DNA
atatagtactctctatag

SEQ ID NO: 72646 - DNA, 18 bp, Artificial Sequence
  Synthetic DNA
atatatgactaacttaag

SEQ ID NO: 72647 - DNA, 18 bp, Artificial Sequence
  Synthetic DNA
atatatgactccctctag

SEQ ID NO: 72648 - DNA, 18 bp, Artificial Sequence
  Synthetic DNA
atattctaaccactatag

SEQ ID NO: 72649 - DNA, 18 bp, Artificial Sequence
  Synthetic DNA
atctgcgtcgcactctag

SEQ ID NO: 72650 - DNA, 18 bp, Artificial Sequence
  Synthetic DNA
atttacaactctctatag

SEQ ID NO: 72651 - DNA, 18 bp, Artificial Sequence
  Synthetic DNA
atttacgaatctctatag

SEQ ID NO: 72652 - DNA, 18 bp, Artificial Sequence
  Synthetic DNA
caaatcgactcactcatg

SEQ ID NO: 72653 - DNA, 18 bp, Artificial Sequence
  Synthetic DNA
caatacgacatacaaaag

SEQ ID NO: 72654 - DNA, 18 bp, Artificial Sequence
  Synthetic DNA
cagaacgacgcactacag

SEQ ID NO: 72655 - DNA, 18 bp, Artificial Sequence
  Synthetic DNA
cgacatgactcactttag

SEQ ID NO: 72656 - DNA, 18 bp, Artificial Sequence
  Synthetic DNA
ctgaacgactcactttag

SEQ ID NO: 72657 - DNA, 18 bp, Artificial Sequence
  Synthetic DNA
gaccacgagtcacgatag

SEQ ID NO: 72658 - DNA, 18 bp, Artificial Sequence
  Synthetic DNA
gatcacgtcacactttag

SEQ ID NO: 72659 - DNA, 18 bp, Artificial Sequence
  Synthetic DNA
taaaaccaaacactatcg

SEQ ID NO: 72660 - DNA, 18 bp, Artificial Sequence
  Synthetic DNA
taaaacgtccccctttag

SEQ ID NO: 72661 - DNA, 18 bp, Artificial Sequence
  Synthetic DNA
taaaacgtctcaaagaag

SEQ ID NO: 72662 - DNA, 18 bp, Artificial Sequence
  Synthetic DNA
taaaactaaacactaatg

SEQ ID NO: 72663 - DNA, 18 bp, Artificial Sequence
  Synthetic DNA
taaaactaatcacaatgg

SEQ ID NO: 72664 - DNA, 18 bp, Artificial Sequence
  Synthetic DNA
taaaatgtcactgtatag

SEQ ID NO: 72665 - DNA, 18 bp, Artificial Sequence
  Synthetic DNA
taaaccgactcatttttg

SEQ ID NO: 72666 - DNA, 18 bp, Artificial Sequence
  Synthetic DNA
taaatcgtctaactattg

SEQ ID NO: 72667 - DNA, 18 bp, Artificial Sequence
  Synthetic DNA
taacacaacccacaattg

SEQ ID NO: 72668 - DNA, 18 bp, Artificial Sequence
  Synthetic DNA
taacacgtcacataatag

SEQ ID NO: 72669 - DNA, 18 bp, Artificial Sequence
  Synthetic DNA
taactcatctcactgtag

SEQ ID NO: 72670 - DNA, 18 bp, Artificial Sequence
  Synthetic DNA
taagacgactcaatgacg

SEQ ID NO: 72671 - DNA, 18 bp, Artificial Sequence
  Synthetic DNA
taataacattaactgtag

SEQ ID NO: 72672 - DNA, 18 bp, Artificial Sequence
  Synthetic DNA
taataagattctcaacag

SEQ ID NO: 72673 - DNA, 18 bp, Artificial Sequence
  Synthetic DNA
taatacaactttatttag

SEQ ID NO: 72674 - DNA, 18 bp, Artificial Sequence
  Synthetic DNA
taatacatctctttttag

SEQ ID NO: 72675 - DNA, 18 bp, Artificial Sequence
  Synthetic DNA
taataccacagaccgtag

SEQ ID NO: 72676 - DNA, 18 bp, Artificial Sequence
  Synthetic DNA
taataccacttccattag

SEQ ID NO: 72677 - DNA, 18 bp, Artificial Sequence
  Synthetic DNA
taatacgattttcttaag

SEQ ID NO: 72678 - DNA, 18 bp, Artificial Sequence
  Synthetic DNA
taatacgtatctcaaaag

SEQ ID NO: 72679 - DNA, 18 bp, Artificial Sequence
  Synthetic DNA
taatacgtcacagttttg

SEQ ID NO: 72680 - DNA, 18 bp, Artificial Sequence
  Synthetic DNA
taatacgtcattcaatag

SEQ ID NO: 72681 - DNA, 18 bp, Artificial Sequence
  Synthetic DNA
taatacgtctatctaatg

SEQ ID NO: 72682 - DNA, 18 bp, Artificial Sequence
  Synthetic DNA
taatacgtttcacattcg

SEQ ID NO: 72683 - DNA, 18 bp, Artificial Sequence
  Synthetic DNA
taatactacttgcttttg

SEQ ID NO: 72684 - DNA, 18 bp, Artificial Sequence
  Synthetic DNA
taataggtctctctcttg

SEQ ID NO: 72685 - DNA, 18 bp, Artificial Sequence
  Synthetic DNA
taatatatctctcaatag

SEQ ID NO: 72686 - DNA, 18 bp, Artificial Sequence
  Synthetic DNA
taatatgactcagccacg

SEQ ID NO: 72687 - DNA, 18 bp, Artificial Sequence
  Synthetic DNA
taatccgaccctcttttg

SEQ ID NO: 72688 - DNA, 18 bp, Artificial Sequence
  Synthetic DNA
taatccgctagactttcg

SEQ ID NO: 72689 - DNA, 18 bp, Artificial Sequence
  Synthetic DNA
taatccttctgactattg

SEQ ID NO: 72690 - DNA, 18 bp, Artificial Sequence
  Synthetic DNA
taatgcgagactatattg

SEQ ID NO: 72691 - DNA, 18 bp, Artificial Sequence
  Synthetic DNA
taatgcggcgcaataaag

SEQ ID NO: 72692 - DNA, 18 bp, Artificial Sequence
  Synthetic DNA
taattagacacattacag

SEQ ID NO: 72693 - DNA, 18 bp, Artificial Sequence
  Synthetic DNA
taattagattccctaaag

SEQ ID NO: 72694 - DNA, 18 bp, Artificial Sequence
  Synthetic DNA
taattcgaattacattag

SEQ ID NO: 72695 - DNA, 18 bp, Artificial Sequence
  Synthetic DNA
taattcgagtctcaattg

SEQ ID NO: 72696 - DNA, 18 bp, Artificial Sequence
  Synthetic DNA
taattcgtatagctatag

SEQ ID NO: 72697 - DNA, 18 bp, Artificial Sequence
  Synthetic DNA
taattcgtcacatcatag

SEQ ID NO: 72698 - DNA, 18 bp, Artificial Sequence
  Synthetic DNA
taattcttctcactcaag

SEQ ID NO: 72699 - DNA, 18 bp, Artificial Sequence
  Synthetic DNA
tacaacgtctaattatag

SEQ ID NO: 72700 - DNA, 18 bp, Artificial Sequence
  Synthetic DNA
tactacgatttacttttg

SEQ ID NO: 72701 - DNA, 18 bp, Artificial Sequence
  Synthetic DNA
tactacgtctcatttttg

SEQ ID NO: 72702 - DNA, 18 bp, Artificial Sequence
  Synthetic DNA
tagcacgactaattgttg

SEQ ID NO: 72703 - DNA, 18 bp, Artificial Sequence
  Synthetic DNA
tagcgtgattcactatag

SEQ ID NO: 72704 - DNA, 18 bp, Artificial Sequence
  Synthetic DNA
tagtccgactcaagagag

SEQ ID NO: 72705 - DNA, 18 bp, Artificial Sequence
  Synthetic DNA
tagttcgaatcattttag

SEQ ID NO: 72706 - DNA, 18 bp, Artificial Sequence
  Synthetic DNA
tagttcgactctcttcag

SEQ ID NO: 72707 - DNA, 18 bp, Artificial Sequence
  Synthetic DNA
tataaccacacactttag

SEQ ID NO: 72708 - DNA, 18 bp, Artificial Sequence
  Synthetic DNA
tataacgacaaactattg

SEQ ID NO: 72709 - DNA, 18 bp, Artificial Sequence
  Synthetic DNA
tataacgacactctaaag

SEQ ID NO: 72710 - DNA, 18 bp, Artificial Sequence
  Synthetic DNA
tataacgacactctattg

SEQ ID NO: 72711 - DNA, 18 bp, Artificial Sequence
  Synthetic DNA
tatagcaacacactatag

SEQ ID NO: 72712 - DNA, 18 bp, Artificial Sequence
  Synthetic DNA
tatcacaaaacataatag

SEQ ID NO: 72713 - DNA, 18 bp, Artificial Sequence
  Synthetic DNA
tatcataactcaccatgg

SEQ ID NO: 72714 - DNA, 18 bp, Artificial Sequence
  Synthetic DNA
tattacgcttcaatattg

SEQ ID NO: 72715 - DNA, 18 bp, Artificial Sequence
  Synthetic DNA
tattacgtctctcaattg

SEQ ID NO: 72716 - DNA, 18 bp, Artificial Sequence
  Synthetic DNA
tattactacactcaatag

SEQ ID NO: 72717 - DNA, 18 bp, Artificial Sequence
  Synthetic DNA
tattataactcactactg

SEQ ID NO: 72718 - DNA, 18 bp, Artificial Sequence
  Synthetic DNA
tattgccactctctattg

SEQ ID NO: 72719 - DNA, 18 bp, Artificial Sequence
  Synthetic DNA
tattgtgtctcacaatag

SEQ ID NO: 72720 - DNA, 18 bp, Artificial Sequence
  Synthetic DNA
tatttagactcacttttg

SEQ ID NO: 72721 - DNA, 18 bp, Artificial Sequence
  Synthetic DNA
tatttcgtctaactaatg

SEQ ID NO: 72722 - DNA, 18 bp, Artificial Sequence
  Synthetic DNA
tatttttactcacaatag

SEQ ID NO: 72723 - DNA, 18 bp, Artificial Sequence
  Synthetic DNA
tcaatcgtcttagtatgg

SEQ ID NO: 72724 - DNA, 18 bp, Artificial Sequence
  Synthetic DNA
tcatacgacatacaattg

SEQ ID NO: 72725 - DNA, 18 bp, Artificial Sequence
  Synthetic DNA
tcatacgacgctgtttag

SEQ ID NO: 72726 - DNA, 18 bp, Artificial Sequence
  Synthetic DNA
tcatacgattatcaatag

SEQ ID NO: 72727 - DNA, 18 bp, Artificial Sequence
  Synthetic DNA
tcatataacttcctatag

SEQ ID NO: 72728 - DNA, 18 bp, Artificial Sequence
  Synthetic DNA
tcatatgacattttatcg

SEQ ID NO: 72729 - DNA, 18 bp, Artificial Sequence
  Synthetic DNA
tcattcttctgaccatag

SEQ ID NO: 72730 - DNA, 18 bp, Artificial Sequence
  Synthetic DNA
tcctcctattcacaaaag

SEQ ID NO: 72731 - DNA, 18 bp, Artificial Sequence
  Synthetic DNA
tccttcgactcacttttg

SEQ ID NO: 72732 - DNA, 18 bp, Artificial Sequence
  Synthetic DNA
tcttactcatcactaatg

SEQ ID NO: 72733 - DNA, 18 bp, Artificial Sequence
  Synthetic DNA
tgaaacaattcattatag

SEQ ID NO: 72734 - DNA, 18 bp, Artificial Sequence
  Synthetic DNA
tgactcaacttactatag

SEQ ID NO: 72735 - DNA, 18 bp, Artificial Sequence
  Synthetic DNA
tgatacaagtctcttaag

SEQ ID NO: 72736 - DNA, 18 bp, Artificial Sequence
  Synthetic DNA
tgatacggctctccattg

SEQ ID NO: 72737 - DNA, 18 bp, Artificial Sequence
  Synthetic DNA
tgatacgtctcatattag

SEQ ID NO: 72738 - DNA, 18 bp, Artificial Sequence
  Synthetic DNA
tgattccattcacaatag

SEQ ID NO: 72739 - DNA, 18 bp, Artificial Sequence
  Synthetic DNA
tgccactatccactattg

SEQ ID NO: 72740 - DNA, 18 bp, Artificial Sequence
  Synthetic DNA
tgtaaccactcactattg

SEQ ID NO: 72741 - DNA, 18 bp, Artificial Sequence
  Synthetic DNA
tgtaacgacacacaatag

SEQ ID NO: 72742 - DNA, 18 bp, Artificial Sequence
  Synthetic DNA
tgttacctctctctttag

SEQ ID NO: 72743 - DNA, 18 bp, Artificial Sequence
  Synthetic DNA
tgttacgactcaatgcag

SEQ ID NO: 72744 - DNA, 18 bp, Artificial Sequence
  Synthetic DNA
ttaaacaactcactcaag

SEQ ID NO: 72745 - DNA, 18 bp, Artificial Sequence
  Synthetic DNA
ttaaacaactcacttaag

SEQ ID NO: 72746 - DNA, 18 bp, Artificial Sequence
  Synthetic DNA
ttaaacgacacaatttag

SEQ ID NO: 72747 - DNA, 18 bp, Artificial Sequence
  Synthetic DNA
ttaaacgcccggcgatag

SEQ ID NO: 72748 - DNA, 18 bp, Artificial Sequence
  Synthetic DNA
ttaaacgtcttatcattg

SEQ ID NO: 72749 - DNA, 18 bp, Artificial Sequence
  Synthetic DNA
ttaatcgactcacaaatg

SEQ ID NO: 72750 - DNA, 18 bp, Artificial Sequence
  Synthetic DNA
ttacgagactccctttgg

SEQ ID NO: 72751 - DNA, 18 bp, Artificial Sequence
  Synthetic DNA
ttactcgacccacaatag

SEQ ID NO: 72752 - DNA, 18 bp, Artificial Sequence
  Synthetic DNA
ttataacactgccaatag

SEQ ID NO: 72753 - DNA, 18 bp, Artificial Sequence
  Synthetic DNA
ttatacccctcacttaag

SEQ ID NO: 72754 - DNA, 18 bp, Artificial Sequence
  Synthetic DNA
ttatacctctctctattg

SEQ ID NO: 72755 - DNA, 18 bp, Artificial Sequence
  Synthetic DNA
ttatacgaataacaatcg

SEQ ID NO: 72756 - DNA, 18 bp, Artificial Sequence
  Synthetic DNA
ttatacgactaatattag

SEQ ID NO: 72757 - DNA, 18 bp, Artificial Sequence
  Synthetic DNA
ttatacgactcgggacag

SEQ ID NO: 72758 - DNA, 18 bp, Artificial Sequence
  Synthetic DNA
ttatacgagtccttatgg

SEQ ID NO: 72759 - DNA, 18 bp, Artificial Sequence
  Synthetic DNA
ttatacgatagattatag

SEQ ID NO: 72760 - DNA, 18 bp, Artificial Sequence
  Synthetic DNA
ttatacgtcacagtacag

SEQ ID NO: 72761 - DNA, 18 bp, Artificial Sequence
  Synthetic DNA
ttatacgtctatcaatag

SEQ ID NO: 72762 - DNA, 18 bp, Artificial Sequence
  Synthetic DNA
ttatacgtctcagttttg

SEQ ID NO: 72763 - DNA, 18 bp, Artificial Sequence
  Synthetic DNA
ttatactacacactgtcg

SEQ ID NO: 72764 - DNA, 18 bp, Artificial Sequence
  Synthetic DNA
ttataggagtctctctag

SEQ ID NO: 72765 - DNA, 18 bp, Artificial Sequence
  Synthetic DNA
ttatattactcacaattg

SEQ ID NO: 72766 - DNA, 18 bp, Artificial Sequence
  Synthetic DNA
ttatattgcactcaaaag

SEQ ID NO: 72767 - DNA, 18 bp, Artificial Sequence
  Synthetic DNA
ttatccaattcattggag

SEQ ID NO: 72768 - DNA, 18 bp, Artificial Sequence
  Synthetic DNA
ttatgagtctcactactg

SEQ ID NO: 72769 - DNA, 18 bp, Artificial Sequence
  Synthetic DNA
ttattcgactcaattaag

SEQ ID NO: 72770 - DNA, 18 bp, Artificial Sequence
  Synthetic DNA
ttcttagactcacattag

SEQ ID NO: 72771 - DNA, 18 bp, Artificial Sequence
  Synthetic DNA
ttgaacgtatcactatag

SEQ ID NO: 72772 - DNA, 18 bp, Artificial Sequence
  Synthetic DNA
tttaacgaatctctatag

SEQ ID NO: 72773 - DNA, 18 bp, Artificial Sequence
  Synthetic DNA
tttaacgacacacttcag

SEQ ID NO: 72774 - DNA, 18 bp, Artificial Sequence
  Synthetic DNA
tttaatgactcactaaag

SEQ ID NO: 72775 - DNA, 18 bp, Artificial Sequence
  Synthetic DNA
ttttaagactcacttaag

SEQ ID NO: 72776 - DNA, 18 bp, Artificial Sequence
  Synthetic DNA
ttttacgacccaccatgg

SEQ ID NO: 72777 - DNA, 18 bp, Artificial Sequence
  Synthetic DNA
ttaaacgtcacactaaag

SEQ ID NO: 72778 - DNA, 18 bp, Artificial Sequence
  Synthetic DNA
tttaacgactctctattg

SEQ ID NO: 72779 - DNA, 18 bp, Artificial Sequence
  Synthetic DNA
aaacacgacttacttaag

SEQ ID NO: 72780 - DNA, 18 bp, Artificial Sequence
  Synthetic DNA
aaataacaatcactttag

SEQ ID NO: 72781 - DNA, 18 bp, Artificial Sequence
  Synthetic DNA
aaataatactctgtatag

SEQ ID NO: 72782 - DNA, 18 bp, Artificial Sequence
  Synthetic DNA
aaatacttcacgctatag

SEQ ID NO: 72783 - DNA, 18 bp, Artificial Sequence
  Synthetic DNA
aaatccgacaaacaatag

SEQ ID NO: 72784 - DNA, 18 bp, Artificial Sequence
  Synthetic DNA
aaatgcacatcactatag

SEQ ID NO: 72785 - DNA, 18 bp, Artificial Sequence
  Synthetic DNA
aaattcgtctcacttaag

SEQ ID NO: 72786 - DNA, 18 bp, Artificial Sequence
  Synthetic DNA
aagtacgagttgcgatag

SEQ ID NO: 72787 - DNA, 18 bp, Artificial Sequence
  Synthetic DNA
aagtacttcacactttag

SEQ ID NO: 72788 - DNA, 18 bp, Artificial Sequence
  Synthetic DNA
aatatcgactcactaaag

SEQ ID NO: 72789 - DNA, 18 bp, Artificial Sequence
  Synthetic DNA
aatcacttctcactatag

SEQ ID NO: 72790 - DNA, 18 bp, Artificial Sequence
  Synthetic DNA
aattacggcttactaaag

SEQ ID NO: 72791 - DNA, 18 bp, Artificial Sequence
  Synthetic DNA
aatttcaattcactatag

SEQ ID NO: 72792 - DNA, 18 bp, Artificial Sequence
  Synthetic DNA
aatttcgtcacactatag

SEQ ID NO: 72793 - DNA, 18 bp, Artificial Sequence
  Synthetic DNA
aatttcgtcgcactctag

SEQ ID NO: 72794 - DNA, 18 bp, Artificial Sequence
  Synthetic DNA
ataaacgaatcattagag

SEQ ID NO: 72795 - DNA, 18 bp, Artificial Sequence
  Synthetic DNA
ataaacgattctctatag

SEQ ID NO: 72796 - DNA, 18 bp, Artificial Sequence
  Synthetic DNA
atataagactcacttttg

SEQ ID NO: 72797 - DNA, 18 bp, Artificial Sequence
  Synthetic DNA
atatacgagtcccaaaag

SEQ ID NO: 72798 - DNA, 18 bp, Artificial Sequence
  Synthetic DNA
atttactactcactattg

SEQ ID NO: 72799 - DNA, 18 bp, Artificial Sequence
  Synthetic DNA
caataccacttacattag

SEQ ID NO: 72800 - DNA, 18 bp, Artificial Sequence
  Synthetic DNA
caatacgactatctcttg

SEQ ID NO: 72801 - DNA, 18 bp, Artificial Sequence
  Synthetic DNA
caatacgagtatcttacg

SEQ ID NO: 72802 - DNA, 18 bp, Artificial Sequence
  Synthetic DNA
caatccgatacactgttg

SEQ ID NO: 72803 - DNA, 18 bp, Artificial Sequence
  Synthetic DNA
cattacgacgctcaacag

SEQ ID NO: 72804 - DNA, 18 bp, Artificial Sequence
  Synthetic DNA
cattacgactctgtattg

SEQ ID NO: 72805 - DNA, 18 bp, Artificial Sequence
  Synthetic DNA
cattacgagtcacaaaag

SEQ ID NO: 72806 - DNA, 18 bp, Artificial Sequence
  Synthetic DNA
ccatacgactcgctaagg

SEQ ID NO: 72807 - DNA, 18 bp, Artificial Sequence
  Synthetic DNA
ccatacggttcccgatag

SEQ ID NO: 72808 - DNA, 18 bp, Artificial Sequence
  Synthetic DNA
ctatgcctcccactttag

SEQ ID NO: 72809 - DNA, 18 bp, Artificial Sequence
  Synthetic DNA
gtatgctacttactaaag

SEQ ID NO: 72810 - DNA, 18 bp, Artificial Sequence
  Synthetic DNA
taaaacgattctacatag

SEQ ID NO: 72811 - DNA, 18 bp, Artificial Sequence
  Synthetic DNA
taaaacgtcacacattag

SEQ ID NO: 72812 - DNA, 18 bp, Artificial Sequence
  Synthetic DNA
taaaacgtctctcaattg

SEQ ID NO: 72813 - DNA, 18 bp, Artificial Sequence
  Synthetic DNA
taaaactaatctcaacag

SEQ ID NO: 72814 - DNA, 18 bp, Artificial Sequence
  Synthetic DNA
taaaccgacctccttttg

SEQ ID NO: 72815 - DNA, 18 bp, Artificial Sequence
  Synthetic DNA
taaatctactcaataaag

SEQ ID NO: 72816 - DNA, 18 bp, Artificial Sequence
  Synthetic DNA
taacacaactgacaacag

SEQ ID NO: 72817 - DNA, 18 bp, Artificial Sequence
  Synthetic DNA
taacacgcatgagtagag

SEQ ID NO: 72818 - DNA, 18 bp, Artificial Sequence
  Synthetic DNA
taacacgtccgactattg

SEQ ID NO: 72819 - DNA, 18 bp, Artificial Sequence
  Synthetic DNA
taacatgactcagtttaa

SEQ ID NO: 72820 - DNA, 18 bp, Artificial Sequence
  Synthetic DNA
taactggtctctctatag

SEQ ID NO: 72821 - DNA, 18 bp, Artificial Sequence
  Synthetic DNA
taataagacactcattag

SEQ ID NO: 72822 - DNA, 18 bp, Artificial Sequence
  Synthetic DNA
taataagtaacgcgattg

SEQ ID NO: 72823 - DNA, 18 bp, Artificial Sequence
  Synthetic DNA
taataagtttcaacgatg

SEQ ID NO: 72824 - DNA, 18 bp, Artificial Sequence
  Synthetic DNA
taataatccacactttag

SEQ ID NO: 72825 - DNA, 18 bp, Artificial Sequence
  Synthetic DNA
taatacaattctcttaag

SEQ ID NO: 72826 - DNA, 18 bp, Artificial Sequence
  Synthetic DNA
taatacatctcaataatg

SEQ ID NO: 72827 - DNA, 18 bp, Artificial Sequence
  Synthetic DNA
taatacctctcaccaatg

SEQ ID NO: 72828 - DNA, 18 bp, Artificial Sequence
  Synthetic DNA
taatacgtctctcgtttg

SEQ ID NO: 72829 - DNA, 18 bp, Artificial Sequence
  Synthetic DNA
taatactattggcattag

SEQ ID NO: 72830 - DNA, 18 bp, Artificial Sequence
  Synthetic DNA
taatacttctcgttattg

SEQ ID NO: 72831 - DNA, 18 bp, Artificial Sequence
  Synthetic DNA
taatacttctctttctag

SEQ ID NO: 72832 - DNA, 18 bp, Artificial Sequence
  Synthetic DNA
taatagaacacaccatgg

SEQ ID NO: 72833 - DNA, 18 bp, Artificial Sequence
  Synthetic DNA
taatatctcacactgtag

SEQ ID NO: 72834 - DNA, 18 bp, Artificial Sequence
  Synthetic DNA
taatatgcctcacatggg

SEQ ID NO: 72835 - DNA, 18 bp, Artificial Sequence
  Synthetic DNA
taatccgacagaaaatag

SEQ ID NO: 72836 - DNA, 18 bp, Artificial Sequence
  Synthetic DNA
taattcgacccatattag

SEQ ID NO: 72837 - DNA, 18 bp, Artificial Sequence
  Synthetic DNA
taattcgtctcaaaacag

SEQ ID NO: 72838 - DNA, 18 bp, Artificial Sequence
  Synthetic DNA
taatttcacacactttag

SEQ ID NO: 72839 - DNA, 18 bp, Artificial Sequence
  Synthetic DNA
tacaacgtgtcaatatag

SEQ ID NO: 72840 - DNA, 18 bp, Artificial Sequence
  Synthetic DNA
tactaagattcacattag

SEQ ID NO: 72841 - DNA, 18 bp, Artificial Sequence
  Synthetic DNA
tagtacggcacaacatgg

SEQ ID NO: 72842 - DNA, 18 bp, Artificial Sequence
  Synthetic DNA
tataaagactcactcaag

SEQ ID NO: 72843 - DNA, 18 bp, Artificial Sequence
  Synthetic DNA
tataacaactaactgtag

SEQ ID NO: 72844 - DNA, 18 bp, Artificial Sequence
  Synthetic DNA
tataacatctcgctattg

SEQ ID NO: 72845 - DNA, 18 bp, Artificial Sequence
  Synthetic DNA
tataactactctcaattg

SEQ ID NO: 72846 - DNA, 18 bp, Artificial Sequence
  Synthetic DNA
tataactactgactaaag

SEQ ID NO: 72847 - DNA, 18 bp, Artificial Sequence
  Synthetic DNA
tataaggactgactaaag

SEQ ID NO: 72848 - DNA, 18 bp, Artificial Sequence
  Synthetic DNA
tataattactctcaatag

SEQ ID NO: 72849 - DNA, 18 bp, Artificial Sequence
  Synthetic DNA
tatatcgaatcactttag

SEQ ID NO: 72850 - DNA, 18 bp, Artificial Sequence
  Synthetic DNA
tatcacatatcactatag

SEQ ID NO: 72851 - DNA, 18 bp, Artificial Sequence
  Synthetic DNA
tatcacgacacaataaag

SEQ ID NO: 72852 - DNA, 18 bp, Artificial Sequence
  Synthetic DNA
tattaaaactaacccttg

SEQ ID NO: 72853 - DNA, 18 bp, Artificial Sequence
  Synthetic DNA
tattacaactttctaaag

SEQ ID NO: 72854 - DNA, 18 bp, Artificial Sequence
  Synthetic DNA
tattacgaatatctattg

SEQ ID NO: 72855 - DNA, 18 bp, Artificial Sequence
  Synthetic DNA
tattacgactatttattg

SEQ ID NO: 72856 - DNA, 18 bp, Artificial Sequence
  Synthetic DNA
tattacgactttcttttg

SEQ ID NO: 72857 - DNA, 18 bp, Artificial Sequence
  Synthetic DNA
tattactattaactttag

SEQ ID NO: 72858 - DNA, 18 bp, Artificial Sequence
  Synthetic DNA
tattacttctcacattag

SEQ ID NO: 72859 - DNA, 18 bp, Artificial Sequence
  Synthetic DNA
tattccgattaactaatg

SEQ ID NO: 72860 - DNA, 18 bp, Artificial Sequence
  Synthetic DNA
tatttcaactcagtatcg

SEQ ID NO: 72861 - DNA, 18 bp, Artificial Sequence
  Synthetic DNA
tatttcgatccacgattg

SEQ ID NO: 72862 - DNA, 18 bp, Artificial Sequence
  Synthetic DNA
tatttctacactctatag

SEQ ID NO: 72863 - DNA, 18 bp, Artificial Sequence
  Synthetic DNA
tatttcttctcactaaag

SEQ ID NO: 72864 - DNA, 18 bp, Artificial Sequence
  Synthetic DNA
tatttgctctcacaatag

SEQ ID NO: 72865 - DNA, 18 bp, Artificial Sequence
  Synthetic DNA
tcacacgtctctctttag

SEQ ID NO: 72866 - DNA, 18 bp, Artificial Sequence
  Synthetic DNA
tcatacattccactattg

SEQ ID NO: 72867 - DNA, 18 bp, Artificial Sequence
  Synthetic DNA
tctctcgactgattctag

SEQ ID NO: 72868 - DNA, 18 bp, Artificial Sequence
  Synthetic DNA
tgaaacgaaccactaaag

SEQ ID NO: 72869 - DNA, 18 bp, Artificial Sequence
  Synthetic DNA
tgagacgacaccctacag

SEQ ID NO: 72870 - DNA, 18 bp, Artificial Sequence
  Synthetic DNA
tgataccacagactattg

SEQ ID NO: 72871 - DNA, 18 bp, Artificial Sequence
  Synthetic DNA
tgatacgacactcttcag

SEQ ID NO: 72872 - DNA, 18 bp, Artificial Sequence
  Synthetic DNA
tgatctgtgtttgtaaag

SEQ ID NO: 72873 - DNA, 18 bp, Artificial Sequence
  Synthetic DNA
tgttacgactcattcaag

SEQ ID NO: 72874 - DNA, 18 bp, Artificial Sequence
  Synthetic DNA
tgtttcgactcattattg

SEQ ID NO: 72875 - DNA, 18 bp, Artificial Sequence
  Synthetic DNA
ttaaacggctcacttttg

SEQ ID NO: 72876 - DNA, 18 bp, Artificial Sequence
  Synthetic DNA
ttaaactacacataatag

SEQ ID NO: 72877 - DNA, 18 bp, Artificial Sequence
  Synthetic DNA
ttacaaggctcacaatag

SEQ ID NO: 72878 - DNA, 18 bp, Artificial Sequence
  Synthetic DNA
ttatacaaccaactattg

SEQ ID NO: 72879 - DNA, 18 bp, Artificial Sequence
  Synthetic DNA
ttatacaactcacattcg

SEQ ID NO: 72880 - DNA, 18 bp, Artificial Sequence
  Synthetic DNA
ttatacgacaaacttaag

SEQ ID NO: 72881 - DNA, 18 bp, Artificial Sequence
  Synthetic DNA
ttatacgacttattaatg

SEQ ID NO: 72882 - DNA, 18 bp, Artificial Sequence
  Synthetic DNA
ttatacgtcacattctag

SEQ ID NO: 72883 - DNA, 18 bp, Artificial Sequence
  Synthetic DNA
ttatacgttccataatag

SEQ ID NO: 72884 - DNA, 18 bp, Artificial Sequence
  Synthetic DNA
ttatatggctctctctag

SEQ ID NO: 72885 - DNA, 18 bp, Artificial Sequence
  Synthetic DNA
ttatccgtctcagtaaag

SEQ ID NO: 72886 - DNA, 18 bp, Artificial Sequence
  Synthetic DNA
ttattagtcacacaattg

SEQ ID NO: 72887 - DNA, 18 bp, Artificial Sequence
  Synthetic DNA
ttattcgacatactatcg

SEQ ID NO: 72888 - DNA, 18 bp, Artificial Sequence
  Synthetic DNA
ttattcgtatctctatag

SEQ ID NO: 72889 - DNA, 18 bp, Artificial Sequence
  Synthetic DNA
ttatttgattcactaaag

SEQ ID NO: 72890 - DNA, 18 bp, Artificial Sequence
  Synthetic DNA
ttcaccgatccacaatag

SEQ ID NO: 72891 - DNA, 18 bp, Artificial Sequence
  Synthetic DNA
ttgcactaatcacaaaag

SEQ ID NO: 72892 - DNA, 18 bp, Artificial Sequence
  Synthetic DNA
ttgtacgaataacttaag

SEQ ID NO: 72893 - DNA, 18 bp, Artificial Sequence
  Synthetic DNA
ttgtacgtgttactatag

SEQ ID NO: 72894 - DNA, 18 bp, Artificial Sequence
  Synthetic DNA
tttaaagactctctttag

SEQ ID NO: 72895 - DNA, 18 bp, Artificial Sequence
  Synthetic DNA
tttttggattcattctcg

SEQ ID NO: 72896 - DNA, 18 bp, Artificial Sequence
  Synthetic DNA
ttttacgactctctaatg

SEQ ID NO: 72897 - DNA, 18 bp, Artificial Sequence
  Synthetic DNA
aaacatcactcacgttag

SEQ ID NO: 72898 - DNA, 18 bp, Artificial Sequence
  Synthetic DNA
aaataagacaaacgatag

SEQ ID NO: 72899 - DNA, 18 bp, Artificial Sequence
  Synthetic DNA
aaatacgacatacaattg

SEQ ID NO: 72900 - DNA, 18 bp, Artificial Sequence
  Synthetic DNA
aaatatgaccgattgatg

SEQ ID NO: 72901 - DNA, 18 bp, Artificial Sequence
  Synthetic DNA
aaattcttttcactatag

SEQ ID NO: 72902 - DNA, 18 bp, Artificial Sequence
  Synthetic DNA
aacttcaactctctacag

SEQ ID NO: 72903 - DNA, 18 bp, Artificial Sequence
  Synthetic DNA
aagcacgacgctctattg

SEQ ID NO: 72904 - DNA, 18 bp, Artificial Sequence
  Synthetic DNA
aataacgaaagacttttg

SEQ ID NO: 72905 - DNA, 18 bp, Artificial Sequence
  Synthetic DNA
aatcactactcacaatag

SEQ ID NO: 72906 - DNA, 18 bp, Artificial Sequence
  Synthetic DNA
aattacgactcaattttg

SEQ ID NO: 72907 - DNA, 18 bp, Artificial Sequence
  Synthetic DNA
aattacgtcatactttag

SEQ ID NO: 72908 - DNA, 18 bp, Artificial Sequence
  Synthetic DNA
actaacgtctcactatag

SEQ ID NO: 72909 - DNA, 18 bp, Artificial Sequence
  Synthetic DNA
agataagaaacactatag

SEQ ID NO: 72910 - DNA, 18 bp, Artificial Sequence
  Synthetic DNA
aggtacgacaagctatcg

SEQ ID NO: 72911 - DNA, 18 bp, Artificial Sequence
  Synthetic DNA
ataaacaaatcactatag

SEQ ID NO: 72912 - DNA, 18 bp, Artificial Sequence
  Synthetic DNA
ataatcaactcactttag

SEQ ID NO: 72913 - DNA, 18 bp, Artificial Sequence
  Synthetic DNA
atatacgaaccacaatag

SEQ ID NO: 72914 - DNA, 18 bp, Artificial Sequence
  Synthetic DNA
atatacgacagaagatag

SEQ ID NO: 72915 - DNA, 18 bp, Artificial Sequence
  Synthetic DNA
atatacgactctcaattg

SEQ ID NO: 72916 - DNA, 18 bp, Artificial Sequence
  Synthetic DNA
atataggcatcacaatgg

SEQ ID NO: 72917 - DNA, 18 bp, Artificial Sequence
  Synthetic DNA
atttaagactcactattg

SEQ ID NO: 72918 - DNA, 18 bp, Artificial Sequence
  Synthetic DNA
caaatcgactttcgtacg

SEQ ID NO: 72919 - DNA, 18 bp, Artificial Sequence
  Synthetic DNA
caatacgattttctttag

SEQ ID NO: 72920 - DNA, 18 bp, Artificial Sequence
  Synthetic DNA
caattccactcaccattg

SEQ ID NO: 72921 - DNA, 18 bp, Artificial Sequence
  Synthetic DNA
ctatatggctcactattg

SEQ ID NO: 72922 - DNA, 18 bp, Artificial Sequence
  Synthetic DNA
taaaaagaatctcaatag

SEQ ID NO: 72923 - DNA, 18 bp, Artificial Sequence
  Synthetic DNA
taaaacgacacttaatag

SEQ ID NO: 72924 - DNA, 18 bp, Artificial Sequence
  Synthetic DNA
taaaacgtcacaccgtag

SEQ ID NO: 72925 - DNA, 18 bp, Artificial Sequence
  Synthetic DNA
taaaactcctcacaaaag

SEQ ID NO: 72926 - DNA, 18 bp, Artificial Sequence
  Synthetic DNA
taaaagattacgctagag

SEQ ID NO: 72927 - DNA, 18 bp, Artificial Sequence
  Synthetic DNA
taaaataactcacttaag

SEQ ID NO: 72928 - DNA, 18 bp, Artificial Sequence
  Synthetic DNA
taaaatgatacacaatag

SEQ ID NO: 72929 - DNA, 18 bp, Artificial Sequence
  Synthetic DNA
taaatcgacttcttatag

SEQ ID NO: 72930 - DNA, 18 bp, Artificial Sequence
  Synthetic DNA
taaatcgatacactttag

SEQ ID NO: 72931 - DNA, 18 bp, Artificial Sequence
  Synthetic DNA
taaattgagtcactgaag

SEQ ID NO: 72932 - DNA, 18 bp, Artificial Sequence
  Synthetic DNA
taacacgacctactcaag

SEQ ID NO: 72933 - DNA, 18 bp, Artificial Sequence
  Synthetic DNA
taactcgactgactaagg

SEQ ID NO: 72934 - DNA, 18 bp, Artificial Sequence
  Synthetic DNA
taataagattctcttttg

SEQ ID NO: 72935 - DNA, 18 bp, Artificial Sequence
  Synthetic DNA
taatacggttcaccactg

SEQ ID NO: 72936 - DNA, 18 bp, Artificial Sequence
  Synthetic DNA
taatacgtataacattag

SEQ ID NO: 72937 - DNA, 18 bp, Artificial Sequence
  Synthetic DNA
taatacgtcccatttttg

SEQ ID NO: 72938 - DNA, 18 bp, Artificial Sequence
  Synthetic DNA
taatacgtctctcatttg

SEQ ID NO: 72939 - DNA, 18 bp, Artificial Sequence
  Synthetic DNA
taatacgtcttacaaatg

SEQ ID NO: 72940 - DNA, 18 bp, Artificial Sequence
  Synthetic DNA
taatactatacacattag

SEQ ID NO: 72941 - DNA, 18 bp, Artificial Sequence
  Synthetic DNA
taatgccaatcacaaaag

SEQ ID NO: 72942 - DNA, 18 bp, Artificial Sequence
  Synthetic DNA
taatgcgtcactctttag

SEQ ID NO: 72943 - DNA, 18 bp, Artificial Sequence
  Synthetic DNA
taattcaacttattattg

SEQ ID NO: 72944 - DNA, 18 bp, Artificial Sequence
  Synthetic DNA
taattccactctctcttg

SEQ ID NO: 72945 - DNA, 18 bp, Artificial Sequence
  Synthetic DNA
taattcctctctcaatag

SEQ ID NO: 72946 - DNA, 18 bp, Artificial Sequence
  Synthetic DNA
taattcgaatttctattg

SEQ ID NO: 72947 - DNA, 18 bp, Artificial Sequence
  Synthetic DNA
taattcgacttacttatg

SEQ ID NO: 72948 - DNA, 18 bp, Artificial Sequence
  Synthetic DNA
taattcgtctaacattag

SEQ ID NO: 72949 - DNA, 18 bp, Artificial Sequence
  Synthetic DNA
taattcgtctctctttgg

SEQ ID NO: 72950 - DNA, 18 bp, Artificial Sequence
  Synthetic DNA
taattcgtctctcttttg

SEQ ID NO: 72951 - DNA, 18 bp, Artificial Sequence
  Synthetic DNA
tactagtactttttatcg

SEQ ID NO: 72952 - DNA, 18 bp, Artificial Sequence
  Synthetic DNA
tagaaggcctcacaatag

SEQ ID NO: 72953 - DNA, 18 bp, Artificial Sequence
  Synthetic DNA
tagtacaccacaatatag

SEQ ID NO: 72954 - DNA, 18 bp, Artificial Sequence
  Synthetic DNA
tataacgacacacattag

SEQ ID NO: 72955 - DNA, 18 bp, Artificial Sequence
  Synthetic DNA
tataacgacctactaagg

SEQ ID NO: 72956 - DNA, 18 bp, Artificial Sequence
  Synthetic DNA
tataaggtctcactttag

SEQ ID NO: 72957 - DNA, 18 bp, Artificial Sequence
  Synthetic DNA
tatatcatctcactatag

SEQ ID NO: 72958 - DNA, 18 bp, Artificial Sequence
  Synthetic DNA
tatcatgagtcactgtag

SEQ ID NO: 72959 - DNA, 18 bp, Artificial Sequence
  Synthetic DNA
tatctcgacactagttag

SEQ ID NO: 72960 - DNA, 18 bp, Artificial Sequence
  Synthetic DNA
tattaaaactcacttaag

SEQ ID NO: 72961 - DNA, 18 bp, Artificial Sequence
  Synthetic DNA
tattacatctcaataaag

SEQ ID NO: 72962 - DNA, 18 bp, Artificial Sequence
  Synthetic DNA
tattacgtctttctttag

SEQ ID NO: 72963 - DNA, 18 bp, Artificial Sequence
  Synthetic DNA
tattacgtttcagtttag

SEQ ID NO: 72964 - DNA, 18 bp, Artificial Sequence
  Synthetic DNA
tattatgactcacgtaag

SEQ ID NO: 72965 - DNA, 18 bp, Artificial Sequence
  Synthetic DNA
tattatgattctctttag

SEQ ID NO: 72966 - DNA, 18 bp, Artificial Sequence
  Synthetic DNA
tattccgactctataaag

SEQ ID NO: 72967 - DNA, 18 bp, Artificial Sequence
  Synthetic DNA
tattgttcctgactaaag

SEQ ID NO: 72968 - DNA, 18 bp, Artificial Sequence
  Synthetic DNA
tatttcgaatcacttcag

SEQ ID NO: 72969 - DNA, 18 bp, Artificial Sequence
  Synthetic DNA
tatttcgactagctttag

SEQ ID NO: 72970 - DNA, 18 bp, Artificial Sequence
  Synthetic DNA
tatttcttctcactattg

SEQ ID NO: 72971 - DNA, 18 bp, Artificial Sequence
  Synthetic DNA
tcatacgactatctttgg

SEQ ID NO: 72972 - DNA, 18 bp, Artificial Sequence
  Synthetic DNA
tcatactcttctctttag

SEQ ID NO: 72973 - DNA, 18 bp, Artificial Sequence
  Synthetic DNA
tcatccgattcaataaag

SEQ ID NO: 72974 - DNA, 18 bp, Artificial Sequence
  Synthetic DNA
tgataagagtccctatcg

SEQ ID NO: 72975 - DNA, 18 bp, Artificial Sequence
  Synthetic DNA
tgataggattccctaaag

SEQ ID NO: 72976 - DNA, 18 bp, Artificial Sequence
  Synthetic DNA
tgatattgctcaatatag

SEQ ID NO: 72977 - DNA, 18 bp, Artificial Sequence
  Synthetic DNA
tgatctgactcaacatag

SEQ ID NO: 72978 - DNA, 18 bp, Artificial Sequence
  Synthetic DNA
tgatgcgtctcacaaaag

SEQ ID NO: 72979 - DNA, 18 bp, Artificial Sequence
  Synthetic DNA
tgattctattctctatag

SEQ ID NO: 72980 - DNA, 18 bp, Artificial Sequence
  Synthetic DNA
ttaaacgactacctttag

SEQ ID NO: 72981 - DNA, 18 bp, Artificial Sequence
  Synthetic DNA
ttaatcgacacactaaag

SEQ ID NO: 72982 - DNA, 18 bp, Artificial Sequence
  Synthetic DNA
ttataagaatcttgtttg

SEQ ID NO: 72983 - DNA, 18 bp, Artificial Sequence
  Synthetic DNA
ttataagattcactaatg

SEQ ID NO: 72984 - DNA, 18 bp, Artificial Sequence
  Synthetic DNA
ttatacaaatctctatcg

SEQ ID NO: 72985 - DNA, 18 bp, Artificial Sequence
  Synthetic DNA
ttatacaactcctgatag

SEQ ID NO: 72986 - DNA, 18 bp, Artificial Sequence
  Synthetic DNA
ttatacgactcatttatg

SEQ ID NO: 72987 - DNA, 18 bp, Artificial Sequence
  Synthetic DNA
ttatacgtcacataatag

SEQ ID NO: 72988 - DNA, 18 bp, Artificial Sequence
  Synthetic DNA
ttatactattcacaatcg

SEQ ID NO: 72989 - DNA, 18 bp, Artificial Sequence
  Synthetic DNA
ttatactattcagtaaag

SEQ ID NO: 72990 - DNA, 18 bp, Artificial Sequence
  Synthetic DNA
ttatagtacacacaatag

SEQ ID NO: 72991 - DNA, 18 bp, Artificial Sequence
  Synthetic DNA
ttatatcattcacaatag

SEQ ID NO: 72992 - DNA, 18 bp, Artificial Sequence
  Synthetic DNA
ttatatgtcttactattg

SEQ ID NO: 72993 - DNA, 18 bp, Artificial Sequence
  Synthetic DNA
ttatctagctcactaaag

SEQ ID NO: 72994 - DNA, 18 bp, Artificial Sequence
  Synthetic DNA
ttatgcgacaccctttag

SEQ ID NO: 72995 - DNA, 18 bp, Artificial Sequence
  Synthetic DNA
ttattcaactcacaattg

SEQ ID NO: 72996 - DNA, 18 bp, Artificial Sequence
  Synthetic DNA
ttattccactctctgtag

SEQ ID NO: 72997 - DNA, 18 bp, Artificial Sequence
  Synthetic DNA
ttattctacttacagtag

SEQ ID NO: 72998 - DNA, 18 bp, Artificial Sequence
  Synthetic DNA
ttcaatgtctcactattg

SEQ ID NO: 72999 - DNA, 18 bp, Artificial Sequence
  Synthetic DNA
ttgaacgactctctttag

SEQ ID NO: 73000 - DNA, 18 bp, Artificial Sequence
  Synthetic DNA
ttttacgaatcacttaag

SEQ ID NO: 73001 - DNA, 18 bp, Artificial Sequence
  Synthetic DNA
ttttacgacacactgaag

SEQ ID NO: 73002 - DNA, 18 bp, Artificial Sequence
  Synthetic DNA
tataactactctctattg

SEQ ID NO: 73003 - DNA, 18 bp, Artificial Sequence
  Synthetic DNA
aaaaacgacacactcttg

SEQ ID NO: 73004 - DNA, 18 bp, Artificial Sequence
  Synthetic DNA
aaaaatgactctcaatag

SEQ ID NO: 73005 - DNA, 18 bp, Artificial Sequence
  Synthetic DNA
aaacacgaatcactttgg

SEQ ID NO: 73006 - DNA, 18 bp, Artificial Sequence
  Synthetic DNA
aaatacagctccctctag

SEQ ID NO: 73007 - DNA, 18 bp, Artificial Sequence
  Synthetic DNA
aaatacgaattacttttg

SEQ ID NO: 73008 - DNA, 18 bp, Artificial Sequence
  Synthetic DNA
aaatacgacatactcgag

SEQ ID NO: 73009 - DNA, 18 bp, Artificial Sequence
  Synthetic DNA
aaatacgtctctcattag

SEQ ID NO: 73010 - DNA, 18 bp, Artificial Sequence
  Synthetic DNA
acatacaactcacttttg

SEQ ID NO: 73011 - DNA, 18 bp, Artificial Sequence
  Synthetic DNA
acatacgactctctaatg

SEQ ID NO: 73012 - DNA, 18 bp, Artificial Sequence
  Synthetic DNA
acgtacgactgactgcag

SEQ ID NO: 73013 - DNA, 18 bp, Artificial Sequence
  Synthetic DNA
ataaacgactcacttttg

SEQ ID NO: 73014 - DNA, 18 bp, Artificial Sequence
  Synthetic DNA
atatacgactaactcaag

SEQ ID NO: 73015 - DNA, 18 bp, Artificial Sequence
  Synthetic DNA
atatacgactcaaaattg

SEQ ID NO: 73016 - DNA, 18 bp, Artificial Sequence
  Synthetic DNA
atatacgactttctattg

SEQ ID NO: 73017 - DNA, 18 bp, Artificial Sequence
  Synthetic DNA
atattcgaatcactattg

SEQ ID NO: 73018 - DNA, 18 bp, Artificial Sequence
  Synthetic DNA
atcatggaccgactattg

SEQ ID NO: 73019 - DNA, 18 bp, Artificial Sequence
  Synthetic DNA
attaactccttactatag

SEQ ID NO: 73020 - DNA, 18 bp, Artificial Sequence
  Synthetic DNA
attcacgactcacaatag

SEQ ID NO: 73021 - DNA, 18 bp, Artificial Sequence
  Synthetic DNA
atttacaacccactatag

SEQ ID NO: 73022 - DNA, 18 bp, Artificial Sequence
  Synthetic DNA
atttacgacgctctaaag

SEQ ID NO: 73023 - DNA, 18 bp, Artificial Sequence
  Synthetic DNA
caataccagtcataatag

SEQ ID NO: 73024 - DNA, 18 bp, Artificial Sequence
  Synthetic DNA
cgatacgacgtaatatcg

SEQ ID NO: 73025 - DNA, 18 bp, Artificial Sequence
  Synthetic DNA
gatatagaaacactacag

SEQ ID NO: 73026 - DNA, 18 bp, Artificial Sequence
  Synthetic DNA
taaaacgattctcttcag

SEQ ID NO: 73027 - DNA, 18 bp, Artificial Sequence
  Synthetic DNA
taaatcgattcacttttg

SEQ ID NO: 73028 - DNA, 18 bp, Artificial Sequence
  Synthetic DNA
taaatctaatcactttag

SEQ ID NO: 73029 - DNA, 18 bp, Artificial Sequence
  Synthetic DNA
taactcgtcacactattg

SEQ ID NO: 73030 - DNA, 18 bp, Artificial Sequence
  Synthetic DNA
taactcgtctcccaatag

SEQ ID NO: 73031 - DNA, 18 bp, Artificial Sequence
  Synthetic DNA
taatacatctcatcgtag

SEQ ID NO: 73032 - DNA, 18 bp, Artificial Sequence
  Synthetic DNA
taataccttgctctattg

SEQ ID NO: 73033 - DNA, 18 bp, Artificial Sequence
  Synthetic DNA
taatacgaacctcaattg

SEQ ID NO: 73034 - DNA, 18 bp, Artificial Sequence
  Synthetic DNA
taatacgccttaaaattg

SEQ ID NO: 73035 - DNA, 18 bp, Artificial Sequence
  Synthetic DNA
taatacgtcatacattag

SEQ ID NO: 73036 - DNA, 18 bp, Artificial Sequence
  Synthetic DNA
taatacgtcatccagcag

SEQ ID NO: 73037 - DNA, 18 bp, Artificial Sequence
  Synthetic DNA
taatacgtctttgtaagg

SEQ ID NO: 73038 - DNA, 18 bp, Artificial Sequence
  Synthetic DNA
taatactaattacgttcg

SEQ ID NO: 73039 - DNA, 18 bp, Artificial Sequence
  Synthetic DNA
taatatgtctgatcatag

SEQ ID NO: 73040 - DNA, 18 bp, Artificial Sequence
  Synthetic DNA
taatcaaactctctatgg

SEQ ID NO: 73041 - DNA, 18 bp, Artificial Sequence
  Synthetic DNA
taatcaacattacaatag

SEQ ID NO: 73042 - DNA, 18 bp, Artificial Sequence
  Synthetic DNA
taattagaatcactaatg

SEQ ID NO: 73043 - DNA, 18 bp, Artificial Sequence
  Synthetic DNA
taatttggcacactattg

SEQ ID NO: 73044 - DNA, 18 bp, Artificial Sequence
  Synthetic DNA
tacgttgcctcactatag

SEQ ID NO: 73045 - DNA, 18 bp, Artificial Sequence
  Synthetic DNA
tactacgatattcaatag

SEQ ID NO: 73046 - DNA, 18 bp, Artificial Sequence
  Synthetic DNA
tacttggacttactattg

SEQ ID NO: 73047 - DNA, 18 bp, Artificial Sequence
  Synthetic DNA
tagcacctctcactattg

SEQ ID NO: 73048 - DNA, 18 bp, Artificial Sequence
  Synthetic DNA
taggacgtctcaataatg

SEQ ID NO: 73049 - DNA, 18 bp, Artificial Sequence
  Synthetic DNA
tagtatcactcgttatag

SEQ ID NO: 73050 - DNA, 18 bp, Artificial Sequence
  Synthetic DNA
tagttccacacactaaag

SEQ ID NO: 73051 - DNA, 18 bp, Artificial Sequence
  Synthetic DNA
tagttctacacacgatag

SEQ ID NO: 73052 - DNA, 18 bp, Artificial Sequence
  Synthetic DNA
tagttctactcacttatg

SEQ ID NO: 73053 - DNA, 18 bp, Artificial Sequence
  Synthetic DNA
tataacgacacacaaaag

SEQ ID NO: 73054 - DNA, 18 bp, Artificial Sequence
  Synthetic DNA
tataacgactctgtttag

SEQ ID NO: 73055 - DNA, 18 bp, Artificial Sequence
  Synthetic DNA
tataaggtctcaatatcg

SEQ ID NO: 73056 - DNA, 18 bp, Artificial Sequence
  Synthetic DNA
tatagcgattgacttttg

SEQ ID NO: 73057 - DNA, 18 bp, Artificial Sequence
  Synthetic DNA
tatatcgactcactaacg

SEQ ID NO: 73058 - DNA, 18 bp, Artificial Sequence
  Synthetic DNA
tatcacgcatctttttag

SEQ ID NO: 73059 - DNA, 18 bp, Artificial Sequence
  Synthetic DNA
tatcacgtctaacgatag

SEQ ID NO: 73060 - DNA, 18 bp, Artificial Sequence
  Synthetic DNA
tatcgctactccctatag

SEQ ID NO: 73061 - DNA, 18 bp, Artificial Sequence
  Synthetic DNA
tatggcgactcattaaag

SEQ ID NO: 73062 - DNA, 18 bp, Artificial Sequence
  Synthetic DNA
tattaagacattctatag

SEQ ID NO: 73063 - DNA, 18 bp, Artificial Sequence
  Synthetic DNA
tattacgacttacttatg

SEQ ID NO: 73064 - DNA, 18 bp, Artificial Sequence
  Synthetic DNA
tattacgatactctttag

SEQ ID NO: 73065 - DNA, 18 bp, Artificial Sequence
  Synthetic DNA
tattacgcttctctttag

SEQ ID NO: 73066 - DNA, 18 bp, Artificial Sequence
  Synthetic DNA
tattactaatcacaaaag

SEQ ID NO: 73067 - DNA, 18 bp, Artificial Sequence
  Synthetic DNA
tattactacacacaattg

SEQ ID NO: 73068 - DNA, 18 bp, Artificial Sequence
  Synthetic DNA
tattaggaagcgatatcg

SEQ ID NO: 73069 - DNA, 18 bp, Artificial Sequence
  Synthetic DNA
tattatgacttacattag

SEQ ID NO: 73070 - DNA, 18 bp, Artificial Sequence
  Synthetic DNA
tatttaaactcactttag

SEQ ID NO: 73071 - DNA, 18 bp, Artificial Sequence
  Synthetic DNA
tatttcgactcatttttg

SEQ ID NO: 73072 - DNA, 18 bp, Artificial Sequence
  Synthetic DNA
tatttcgtcactctatag

SEQ ID NO: 73073 - DNA, 18 bp, Artificial Sequence
  Synthetic DNA
tcatacgattaactcatg

SEQ ID NO: 73074 - DNA, 18 bp, Artificial Sequence
  Synthetic DNA
tcattcgtcttactttag

SEQ ID NO: 73075 - DNA, 18 bp, Artificial Sequence
  Synthetic DNA
tgaccccactgcgtatag

SEQ ID NO: 73076 - DNA, 18 bp, Artificial Sequence
  Synthetic DNA
tgatccgattcaccattg

SEQ ID NO: 73077 - DNA, 18 bp, Artificial Sequence
  Synthetic DNA
tgatgttgctcactattg

SEQ ID NO: 73078 - DNA, 18 bp, Artificial Sequence
  Synthetic DNA
ttaaacaactcaataaag

SEQ ID NO: 73079 - DNA, 18 bp, Artificial Sequence
  Synthetic DNA
ttaaataactctctatag

SEQ ID NO: 73080 - DNA, 18 bp, Artificial Sequence
  Synthetic DNA
ttaagcgtttcactatag

SEQ ID NO: 73081 - DNA, 18 bp, Artificial Sequence
  Synthetic DNA
ttacacgactctataaag

SEQ ID NO: 73082 - DNA, 18 bp, Artificial Sequence
  Synthetic DNA
ttatacgaatcacttatg

SEQ ID NO: 73083 - DNA, 18 bp, Artificial Sequence
  Synthetic DNA
ttatacgtcactccatag

SEQ ID NO: 73084 - DNA, 18 bp, Artificial Sequence
  Synthetic DNA
ttatacgttgcccaatag

SEQ ID NO: 73085 - DNA, 18 bp, Artificial Sequence
  Synthetic DNA
ttatactaatttcttttg

SEQ ID NO: 73086 - DNA, 18 bp, Artificial Sequence
  Synthetic DNA
ttatactacacactcaag

SEQ ID NO: 73087 - DNA, 18 bp, Artificial Sequence
  Synthetic DNA
ttataggactaaataaag

SEQ ID NO: 73088 - DNA, 18 bp, Artificial Sequence
  Synthetic DNA
ttatatgacacacttttg

SEQ ID NO: 73089 - DNA, 18 bp, Artificial Sequence
  Synthetic DNA
ttatattactcactaatg

SEQ ID NO: 73090 - DNA, 18 bp, Artificial Sequence
  Synthetic DNA
ttattcaactatctatag

SEQ ID NO: 73091 - DNA, 18 bp, Artificial Sequence
  Synthetic DNA
ttattcaactccttatag

SEQ ID NO: 73092 - DNA, 18 bp, Artificial Sequence
  Synthetic DNA
ttattcaactctttatag

SEQ ID NO: 73093 - DNA, 18 bp, Artificial Sequence
  Synthetic DNA
ttattccacacactctag

SEQ ID NO: 73094 - DNA, 18 bp, Artificial Sequence
  Synthetic DNA
ttattcgattcattaaag

SEQ ID NO: 73095 - DNA, 18 bp, Artificial Sequence
  Synthetic DNA
ttgtactgctctctatag

SEQ ID NO: 73096 - DNA, 18 bp, Artificial Sequence
  Synthetic DNA
ttttaaaactcaatatag

SEQ ID NO: 73097 - DNA, 18 bp, Artificial Sequence
  Synthetic DNA
ttttacaactcacattag

SEQ ID NO: 73098 - DNA, 18 bp, Artificial Sequence
  Synthetic DNA
ttttgctactcattattg

SEQ ID NO: 73099 - DNA, 18 bp, Artificial Sequence
  Synthetic DNA
tatatagactcacaatag

SEQ ID NO: 73100 - DNA, 18 bp, Artificial Sequence
  Synthetic DNA
aaactcgactcacttaag

SEQ ID NO: 73101 - DNA, 18 bp, Artificial Sequence
  Synthetic DNA
aaatacaattcacttaag

SEQ ID NO: 73102 - DNA, 18 bp, Artificial Sequence
  Synthetic DNA
aaatacaattctctaaag

SEQ ID NO: 73103 - DNA, 18 bp, Artificial Sequence
  Synthetic DNA
aaatacgaatctccaatg

SEQ ID NO: 73104 - DNA, 18 bp, Artificial Sequence
  Synthetic DNA
aaatccaactcattaaag

SEQ ID NO: 73105 - DNA, 18 bp, Artificial Sequence
  Synthetic DNA
aaattcgactcacttatg

SEQ ID NO: 73106 - DNA, 18 bp, Artificial Sequence
  Synthetic DNA
aattacgtctcactaatg

SEQ ID NO: 73107 - DNA, 18 bp, Artificial Sequence
  Synthetic DNA
agatacgacccattttag

SEQ ID NO: 73108 - DNA, 18 bp, Artificial Sequence
  Synthetic DNA
ataaacgaatcacttaag

SEQ ID NO: 73109 - DNA, 18 bp, Artificial Sequence
  Synthetic DNA
atatacaaatcactattg

SEQ ID NO: 73110 - DNA, 18 bp, Artificial Sequence
  Synthetic DNA
atatacaatccactatag

SEQ ID NO: 73111 - DNA, 18 bp, Artificial Sequence
  Synthetic DNA
atatacgactaacattag

SEQ ID NO: 73112 - DNA, 18 bp, Artificial Sequence
  Synthetic DNA
atataggacacactaaag

SEQ ID NO: 73113 - DNA, 18 bp, Artificial Sequence
  Synthetic DNA
atatatgacttacaatag

SEQ ID NO: 73114 - DNA, 18 bp, Artificial Sequence
  Synthetic DNA
atattcggctcactcaag

SEQ ID NO: 73115 - DNA, 18 bp, Artificial Sequence
  Synthetic DNA
attttctactcactattg

SEQ ID NO: 73116 - DNA, 18 bp, Artificial Sequence
  Synthetic DNA
caaaacgtcacacaaaag

SEQ ID NO: 73117 - DNA, 18 bp, Artificial Sequence
  Synthetic DNA
caacacgactcagtaagg

SEQ ID NO: 73118 - DNA, 18 bp, Artificial Sequence
  Synthetic DNA
cactacgatttacaatag

SEQ ID NO: 73119 - DNA, 18 bp, Artificial Sequence
  Synthetic DNA
ctttaggaatcactaaag

SEQ ID NO: 73120 - DNA, 18 bp, Artificial Sequence
  Synthetic DNA
taaaaagtctatctatag

SEQ ID NO: 73121 - DNA, 18 bp, Artificial Sequence
  Synthetic DNA
taaaacaactcatttttg

SEQ ID NO: 73122 - DNA, 18 bp, Artificial Sequence
  Synthetic DNA
taactagactcaatctag

SEQ ID NO: 73123 - DNA, 18 bp, Artificial Sequence
  Synthetic DNA
taatacaacactcaaaag

SEQ ID NO: 73124 - DNA, 18 bp, Artificial Sequence
  Synthetic DNA
taataccacaagctcttg

SEQ ID NO: 73125 - DNA, 18 bp, Artificial Sequence
  Synthetic DNA
taatacctaccactattg

SEQ ID NO: 73126 - DNA, 18 bp, Artificial Sequence
  Synthetic DNA
taatacgacacacatatg

SEQ ID NO: 73127 - DNA, 18 bp, Artificial Sequence
  Synthetic DNA
taatacggctctcagttg

SEQ ID NO: 73128 - DNA, 18 bp, Artificial Sequence
  Synthetic DNA
taatactaatccctgaag

SEQ ID NO: 73129 - DNA, 18 bp, Artificial Sequence
  Synthetic DNA
taatactactcgcgtgag

SEQ ID NO: 73130 - DNA, 18 bp, Artificial Sequence
  Synthetic DNA
taatatgactctcatttg

SEQ ID NO: 73131 - DNA, 18 bp, Artificial Sequence
  Synthetic DNA
taattagacacacttttg

SEQ ID NO: 73132 - DNA, 18 bp, Artificial Sequence
  Synthetic DNA
taattcaactatcaatag

SEQ ID NO: 73133 - DNA, 18 bp, Artificial Sequence
  Synthetic DNA
taattcgattggcttttg

SEQ ID NO: 73134 - DNA, 18 bp, Artificial Sequence
  Synthetic DNA
taattcgtctatctattg

SEQ ID NO: 73135 - DNA, 18 bp, Artificial Sequence
  Synthetic DNA
tacaaggccttactttag

SEQ ID NO: 73136 - DNA, 18 bp, Artificial Sequence
  Synthetic DNA
tacaatgagtcacaatag

SEQ ID NO: 73137 - DNA, 18 bp, Artificial Sequence
  Synthetic DNA
tataacgactttctattg

SEQ ID NO: 73138 - DNA, 18 bp, Artificial Sequence
  Synthetic DNA
tattaagaatcacaaaag

SEQ ID NO: 73139 - DNA, 18 bp, Artificial Sequence
  Synthetic DNA
tattacaacacaccaaag

SEQ ID NO: 73140 - DNA, 18 bp, Artificial Sequence
  Synthetic DNA
tattacaactctcaaaag

SEQ ID NO: 73141 - DNA, 18 bp, Artificial Sequence
  Synthetic DNA
tattacatatcactttgg

SEQ ID NO: 73142 - DNA, 18 bp, Artificial Sequence
  Synthetic DNA
tattaccaaacacttaag

SEQ ID NO: 73143 - DNA, 18 bp, Artificial Sequence
  Synthetic DNA
tattacgtctctcttaag

SEQ ID NO: 73144 - DNA, 18 bp, Artificial Sequence
  Synthetic DNA
tattacgtctttttatag

SEQ ID NO: 73145 - DNA, 18 bp, Artificial Sequence
  Synthetic DNA
tattactacacgctctag

SEQ ID NO: 73146 - DNA, 18 bp, Artificial Sequence
  Synthetic DNA
tattactactcgcaattg

SEQ ID NO: 73147 - DNA, 18 bp, Artificial Sequence
  Synthetic DNA
tattactactttctaaag

SEQ ID NO: 73148 - DNA, 18 bp, Artificial Sequence
  Synthetic DNA
tattactatttattatag

SEQ ID NO: 73149 - DNA, 18 bp, Artificial Sequence
  Synthetic DNA
tattatccctcactaaag

SEQ ID NO: 73150 - DNA, 18 bp, Artificial Sequence
  Synthetic DNA
tatttcgacacaccttag

SEQ ID NO: 73151 - DNA, 18 bp, Artificial Sequence
  Synthetic DNA
tatttctgctcacctaag

SEQ ID NO: 73152 - DNA, 18 bp, Artificial Sequence
  Synthetic DNA
tcatacgaatctttttgg

SEQ ID NO: 73153 - DNA, 18 bp, Artificial Sequence
  Synthetic DNA
tcattcgactgtctttag

SEQ ID NO: 73154 - DNA, 18 bp, Artificial Sequence
  Synthetic DNA
tcgtacgacgcacattag

SEQ ID NO: 73155 - DNA, 18 bp, Artificial Sequence
  Synthetic DNA
tcttacgactcacttatg

SEQ ID NO: 73156 - DNA, 18 bp, Artificial Sequence
  Synthetic DNA
tgattcgtctcacaaaag

SEQ ID NO: 73157 - DNA, 18 bp, Artificial Sequence
  Synthetic DNA
ttaaaattctcgctaatg

SEQ ID NO: 73158 - DNA, 18 bp, Artificial Sequence
  Synthetic DNA
ttaagcgaatctctattg

SEQ ID NO: 73159 - DNA, 18 bp, Artificial Sequence
  Synthetic DNA
ttataagacttgctttag

SEQ ID NO: 73160 - DNA, 18 bp, Artificial Sequence
  Synthetic DNA
ttatacaacacactttcg

SEQ ID NO: 73161 - DNA, 18 bp, Artificial Sequence
  Synthetic DNA
ttatacgactctacattg

SEQ ID NO: 73162 - DNA, 18 bp, Artificial Sequence
  Synthetic DNA
ttatactacactctattg

SEQ ID NO: 73163 - DNA, 18 bp, Artificial Sequence
  Synthetic DNA
ttatccgactcacttatg

SEQ ID NO: 73164 - DNA, 18 bp, Artificial Sequence
  Synthetic DNA
ttatccggcacactaaag

SEQ ID NO: 73165 - DNA, 18 bp, Artificial Sequence
  Synthetic DNA
ttattcaactcacaaaag

SEQ ID NO: 73166 - DNA, 18 bp, Artificial Sequence
  Synthetic DNA
ttgtacctttcactatag

SEQ ID NO: 73167 - DNA, 18 bp, Artificial Sequence
  Synthetic DNA
tttaacgattcacaatag

SEQ ID NO: 73168 - DNA, 18 bp, Artificial Sequence
  Synthetic DNA
ttttacgtctcacataag

SEQ ID NO: 73169 - DNA, 18 bp, Artificial Sequence
  Synthetic DNA
atatacgtctcacttttg

SEQ ID NO: 73170 - DNA, 18 bp, Artificial Sequence
  Synthetic DNA
ttatacgtctctcaattg

SEQ ID NO: 73171 - DNA, 18 bp, Artificial Sequence
  Synthetic DNA
aatttcgactcacaattg

SEQ ID NO: 73172 - DNA, 18 bp, Artificial Sequence
  Synthetic DNA
aaatacgacttacaaatg

SEQ ID NO: 73173 - DNA, 18 bp, Artificial Sequence
  Synthetic DNA
aaatacgtctctttttag

SEQ ID NO: 73174 - DNA, 18 bp, Artificial Sequence
  Synthetic DNA
aaatacgtttcacaaaag

SEQ ID NO: 73175 - DNA, 18 bp, Artificial Sequence
  Synthetic DNA
aaatactaatcattttag

SEQ ID NO: 73176 - DNA, 18 bp, Artificial Sequence
  Synthetic DNA
aagttcgattctctttag

SEQ ID NO: 73177 - DNA, 18 bp, Artificial Sequence
  Synthetic DNA
aatggccaatcactgtag

SEQ ID NO: 73178 - DNA, 18 bp, Artificial Sequence
  Synthetic DNA
acatacgtctcaccattg

SEQ ID NO: 73179 - DNA, 18 bp, Artificial Sequence
  Synthetic DNA
atatacgccttccaatgg

SEQ ID NO: 73180 - DNA, 18 bp, Artificial Sequence
  Synthetic DNA
atatactacactctatag

SEQ ID NO: 73181 - DNA, 18 bp, Artificial Sequence
  Synthetic DNA
atattcgacacactaaag

SEQ ID NO: 73182 - DNA, 18 bp, Artificial Sequence
  Synthetic DNA
gattactacactctctag

SEQ ID NO: 73183 - DNA, 18 bp, Artificial Sequence
  Synthetic DNA
taaaacgactcacagatg

SEQ ID NO: 73184 - DNA, 18 bp, Artificial Sequence
  Synthetic DNA
taaaatgtctcgctttag

SEQ ID NO: 73185 - DNA, 18 bp, Artificial Sequence
  Synthetic DNA
taaatttactcactacag

SEQ ID NO: 73186 - DNA, 18 bp, Artificial Sequence
  Synthetic DNA
taataaggcttacccttg

SEQ ID NO: 73187 - DNA, 18 bp, Artificial Sequence
  Synthetic DNA
taatacgattgaaaaagg

SEQ ID NO: 73188 - DNA, 18 bp, Artificial Sequence
  Synthetic DNA
taatacgtatcttcatag

SEQ ID NO: 73189 - DNA, 18 bp, Artificial Sequence
  Synthetic DNA
taatcacactcaatttag

SEQ ID NO: 73190 - DNA, 18 bp, Artificial Sequence
  Synthetic DNA
taatcattatcactatag

SEQ ID NO: 73191 - DNA, 18 bp, Artificial Sequence
  Synthetic DNA
taatccatctctctattg

SEQ ID NO: 73192 - DNA, 18 bp, Artificial Sequence
  Synthetic DNA
taatgcgtctcattggag

SEQ ID NO: 73193 - DNA, 18 bp, Artificial Sequence
  Synthetic DNA
taattacactcattttag

SEQ ID NO: 73194 - DNA, 18 bp, Artificial Sequence
  Synthetic DNA
taattcaagtctcaatag

SEQ ID NO: 73195 - DNA, 18 bp, Artificial Sequence
  Synthetic DNA
taattcgcctctttattg

SEQ ID NO: 73196 - DNA, 18 bp, Artificial Sequence
  Synthetic DNA
taattcgtctgtctattg

SEQ ID NO: 73197 - DNA, 18 bp, Artificial Sequence
  Synthetic DNA
tagttcgtctgacaatag

SEQ ID NO: 73198 - DNA, 18 bp, Artificial Sequence
  Synthetic DNA
tatatcgactcacattag

SEQ ID NO: 73199 - DNA, 18 bp, Artificial Sequence
  Synthetic DNA
tatcacgactctttattg

SEQ ID NO: 73200 - DNA, 18 bp, Artificial Sequence
  Synthetic DNA
tattacaacttactgtgg

SEQ ID NO: 73201 - DNA, 18 bp, Artificial Sequence
  Synthetic DNA
tattacgacccacaaatg

SEQ ID NO: 73202 - DNA, 18 bp, Artificial Sequence
  Synthetic DNA
tattacgtcccacttaag

SEQ ID NO: 73203 - DNA, 18 bp, Artificial Sequence
  Synthetic DNA
tattactactcatttaag

SEQ ID NO: 73204 - DNA, 18 bp, Artificial Sequence
  Synthetic DNA
tatttcgatctactatag

SEQ ID NO: 73205 - DNA, 18 bp, Artificial Sequence
  Synthetic DNA
tattttttctcactatag

SEQ ID NO: 73206 - DNA, 18 bp, Artificial Sequence
  Synthetic DNA
tcgtacgacaagatatag

SEQ ID NO: 73207 - DNA, 18 bp, Artificial Sequence
  Synthetic DNA
tgcttcgctttacaatag

SEQ ID NO: 73208 - DNA, 18 bp, Artificial Sequence
  Synthetic DNA
ttaaaagtctcacaatag

SEQ ID NO: 73209 - DNA, 18 bp, Artificial Sequence
  Synthetic DNA
ttaaatgtctaactatcg

SEQ ID NO: 73210 - DNA, 18 bp, Artificial Sequence
  Synthetic DNA
ttatacgtaacactaaag

SEQ ID NO: 73211 - DNA, 18 bp, Artificial Sequence
  Synthetic DNA
ttatacgtcactctagag

SEQ ID NO: 73212 - DNA, 18 bp, Artificial Sequence
  Synthetic DNA
ttatacttctctcaatag

SEQ ID NO: 73213 - DNA, 18 bp, Artificial Sequence
  Synthetic DNA
ttattctacatacataag

SEQ ID NO: 73214 - DNA, 18 bp, Artificial Sequence
  Synthetic DNA
ttctactactaattatag

SEQ ID NO: 73215 - DNA, 18 bp, Artificial Sequence
  Synthetic DNA
ttgtatgcctcactttag

SEQ ID NO: 73216 - DNA, 18 bp, Artificial Sequence
  Synthetic DNA
ttttattactcactaaag

SEQ ID NO: 73217 - DNA, 18 bp, Artificial Sequence
  Synthetic DNA
ttttccgattcactatgg

SEQ ID NO: 73218 - DNA, 18 bp, Artificial Sequence
  Synthetic DNA
aaaaacgtctctctattg

SEQ ID NO: 73219 - DNA, 18 bp, Artificial Sequence
  Synthetic DNA
aaatgcgactgacaatgg

SEQ ID NO: 73220 - DNA, 18 bp, Artificial Sequence
  Synthetic DNA
aattacgattcacaaaag

SEQ ID NO: 73221 - DNA, 18 bp, Artificial Sequence
  Synthetic DNA
aattatgactaactaaag

SEQ ID NO: 73222 - DNA, 18 bp, Artificial Sequence
  Synthetic DNA
atattcgactcaccattg

SEQ ID NO: 73223 - DNA, 18 bp, Artificial Sequence
  Synthetic DNA
taaaacgattctctttcg

SEQ ID NO: 73224 - DNA, 18 bp, Artificial Sequence
  Synthetic DNA
taaagcgactcactcatg

SEQ ID NO: 73225 - DNA, 18 bp, Artificial Sequence
  Synthetic DNA
taaatggactcactaatg

SEQ ID NO: 73226 - DNA, 18 bp, Artificial Sequence
  Synthetic DNA
taatacgaatctttaatg

SEQ ID NO: 73227 - DNA, 18 bp, Artificial Sequence
  Synthetic DNA
taatacgatattctttag

SEQ ID NO: 73228 - DNA, 18 bp, Artificial Sequence
  Synthetic DNA
taatactacacacataag

SEQ ID NO: 73229 - DNA, 18 bp, Artificial Sequence
  Synthetic DNA
taatactgcaggctatag

SEQ ID NO: 73230 - DNA, 18 bp, Artificial Sequence
  Synthetic DNA
taatacttctcacatttg

SEQ ID NO: 73231 - DNA, 18 bp, Artificial Sequence
  Synthetic DNA
taatatatctctctattg

SEQ ID NO: 73232 - DNA, 18 bp, Artificial Sequence
  Synthetic DNA
taatgcggcactccgtag

SEQ ID NO: 73233 - DNA, 18 bp, Artificial Sequence
  Synthetic DNA
taattagtctcactttcg

SEQ ID NO: 73234 - DNA, 18 bp, Artificial Sequence
  Synthetic DNA
taattcgaataacttttg

SEQ ID NO: 73235 - DNA, 18 bp, Artificial Sequence
  Synthetic DNA
taattcgcatcaccattg

SEQ ID NO: 73236 - DNA, 18 bp, Artificial Sequence
  Synthetic DNA
tactacgtctgaattaag

SEQ ID NO: 73237 - DNA, 18 bp, Artificial Sequence
  Synthetic DNA
tagttctactctgtatag

SEQ ID NO: 73238 - DNA, 18 bp, Artificial Sequence
  Synthetic DNA
tatatcgattcactaaag

SEQ ID NO: 73239 - DNA, 18 bp, Artificial Sequence
  Synthetic DNA
tatcacaactaacaatag

SEQ ID NO: 73240 - DNA, 18 bp, Artificial Sequence
  Synthetic DNA
tattacgtatcacaattg

SEQ ID NO: 73241 - DNA, 18 bp, Artificial Sequence
  Synthetic DNA
tattactactcacaaatg

SEQ ID NO: 73242 - DNA, 18 bp, Artificial Sequence
  Synthetic DNA
tattacttctcattattg

SEQ ID NO: 73243 - DNA, 18 bp, Artificial Sequence
  Synthetic DNA
tattatgtttctctaaag

SEQ ID NO: 73244 - DNA, 18 bp, Artificial Sequence
  Synthetic DNA
tattctgcttaactacag

SEQ ID NO: 73245 - DNA, 18 bp, Artificial Sequence
  Synthetic DNA
tatttagattcacaatag

SEQ ID NO: 73246 - DNA, 18 bp, Artificial Sequence
  Synthetic DNA
tatttcaactcacattag

SEQ ID NO: 73247 - DNA, 18 bp, Artificial Sequence
  Synthetic DNA
tatttcgtattactatag

SEQ ID NO: 73248 - DNA, 18 bp, Artificial Sequence
  Synthetic DNA
tcatactacttacttttg

SEQ ID NO: 73249 - DNA, 18 bp, Artificial Sequence
  Synthetic DNA
tctaatgactcactattg

SEQ ID NO: 73250 - DNA, 18 bp, Artificial Sequence
  Synthetic DNA
tctctcgattcattgaag

SEQ ID NO: 73251 - DNA, 18 bp, Artificial Sequence
  Synthetic DNA
tgctcccactttcatttg

SEQ ID NO: 73252 - DNA, 18 bp, Artificial Sequence
  Synthetic DNA
ttaatcgacacactttag

SEQ ID NO: 73253 - DNA, 18 bp, Artificial Sequence
  Synthetic DNA
ttatacaattcaccaaag

SEQ ID NO: 73254 - DNA, 18 bp, Artificial Sequence
  Synthetic DNA
ttatacgactctattaag

SEQ ID NO: 73255 - DNA, 18 bp, Artificial Sequence
  Synthetic DNA
ttatacgtcactctaaag

SEQ ID NO: 73256 - DNA, 18 bp, Artificial Sequence
  Synthetic DNA
ttatacgtctcactcatg

SEQ ID NO: 73257 - DNA, 18 bp, Artificial Sequence
  Synthetic DNA
ttatacgtctcacttatg

SEQ ID NO: 73258 - DNA, 18 bp, Artificial Sequence
  Synthetic DNA
ttatactaattcctatag

SEQ ID NO: 73259 - DNA, 18 bp, Artificial Sequence
  Synthetic DNA
ttattcaacttactaaag

SEQ ID NO: 73260 - DNA, 18 bp, Artificial Sequence
  Synthetic DNA
ttattctactcattaaag

SEQ ID NO: 73261 - DNA, 18 bp, Artificial Sequence
  Synthetic DNA
ttctactcctcgctaaag

SEQ ID NO: 73262 - DNA, 18 bp, Artificial Sequence
  Synthetic DNA
aaaaacgactctctaatg

SEQ ID NO: 73263 - DNA, 18 bp, Artificial Sequence
  Synthetic DNA
aagtaggaaacactttag

SEQ ID NO: 73264 - DNA, 18 bp, Artificial Sequence
  Synthetic DNA
aattactactctcaatag

SEQ ID NO: 73265 - DNA, 18 bp, Artificial Sequence
  Synthetic DNA
aatttcgacacaccttcg

SEQ ID NO: 73266 - DNA, 18 bp, Artificial Sequence
  Synthetic DNA
cgttccgtcttactagag

SEQ ID NO: 73267 - DNA, 18 bp, Artificial Sequence
  Synthetic DNA
gaaaacgataaactattg

SEQ ID NO: 73268 - DNA, 18 bp, Artificial Sequence
  Synthetic DNA
taaaacgatacacaaaag

SEQ ID NO: 73269 - DNA, 18 bp, Artificial Sequence
  Synthetic DNA
taaaactactcacaaatg

SEQ ID NO: 73270 - DNA, 18 bp, Artificial Sequence
  Synthetic DNA
taaatcgaatcacattag

SEQ ID NO: 73271 - DNA, 18 bp, Artificial Sequence
  Synthetic DNA
taataagactttcttaag

SEQ ID NO: 73272 - DNA, 18 bp, Artificial Sequence
  Synthetic DNA
taatacatcacacttttg

SEQ ID NO: 73273 - DNA, 18 bp, Artificial Sequence
  Synthetic DNA
taatacgcttcaattcag

SEQ ID NO: 73274 - DNA, 18 bp, Artificial Sequence
  Synthetic DNA
taatacgtttctcaaaag

SEQ ID NO: 73275 - DNA, 18 bp, Artificial Sequence
  Synthetic DNA
taatactactatcgattg

SEQ ID NO: 73276 - DNA, 18 bp, Artificial Sequence
  Synthetic DNA
taatactatttacttttg

SEQ ID NO: 73277 - DNA, 18 bp, Artificial Sequence
  Synthetic DNA
taatgcgtcttacaattg

SEQ ID NO: 73278 - DNA, 18 bp, Artificial Sequence
  Synthetic DNA
taatttgacactctttag

SEQ ID NO: 73279 - DNA, 18 bp, Artificial Sequence
  Synthetic DNA
tacaacgttccactttag

SEQ ID NO: 73280 - DNA, 18 bp, Artificial Sequence
  Synthetic DNA
tactacaactctcttatg

SEQ ID NO: 73281 - DNA, 18 bp, Artificial Sequence
  Synthetic DNA
tataacgtatcactaaag

SEQ ID NO: 73282 - DNA, 18 bp, Artificial Sequence
  Synthetic DNA
tataacgtcacacaatag

SEQ ID NO: 73283 - DNA, 18 bp, Artificial Sequence
  Synthetic DNA
tatatcaactcataatag

SEQ ID NO: 73284 - DNA, 18 bp, Artificial Sequence
  Synthetic DNA
tatatctacacactatag

SEQ ID NO: 73285 - DNA, 18 bp, Artificial Sequence
  Synthetic DNA
tattacgtatccctatcg

SEQ ID NO: 73286 - DNA, 18 bp, Artificial Sequence
  Synthetic DNA
tatttcatttcactatag

SEQ ID NO: 73287 - DNA, 18 bp, Artificial Sequence
  Synthetic DNA
tcttccgacacattatag

SEQ ID NO: 73288 - DNA, 18 bp, Artificial Sequence
  Synthetic DNA
tgattcgactcacatcag

SEQ ID NO: 73289 - DNA, 18 bp, Artificial Sequence
  Synthetic DNA
tgttacgattcactttcg

SEQ ID NO: 73290 - DNA, 18 bp, Artificial Sequence
  Synthetic DNA
ttaaacgacactctattg

SEQ ID NO: 73291 - DNA, 18 bp, Artificial Sequence
  Synthetic DNA
ttatacatccctctatag

SEQ ID NO: 73292 - DNA, 18 bp, Artificial Sequence
  Synthetic DNA
ttatacgaaacgcgattg

SEQ ID NO: 73293 - DNA, 18 bp, Artificial Sequence
  Synthetic DNA
ttatacgattcacttatg

SEQ ID NO: 73294 - DNA, 18 bp, Artificial Sequence
  Synthetic DNA
ttattcggctctcaatag

SEQ ID NO: 73295 - DNA, 18 bp, Artificial Sequence
  Synthetic DNA
ttatttgactttcaatag

SEQ ID NO: 73296 - DNA, 18 bp, Artificial Sequence
  Synthetic DNA
ttgatcgactcacactag

SEQ ID NO: 73297 - DNA, 18 bp, Artificial Sequence
  Synthetic DNA
tttaacgacacactaaag

SEQ ID NO: 73298 - DNA, 18 bp, Artificial Sequence
  Synthetic DNA
ttttacgacaccctttag

SEQ ID NO: 73299 - DNA, 18 bp, Artificial Sequence
  Synthetic DNA
aatttcgacacactattg

SEQ ID NO: 73300 - DNA, 18 bp, Artificial Sequence
  Synthetic DNA
acatacgactcacattcg

SEQ ID NO: 73301 - DNA, 18 bp, Artificial Sequence
  Synthetic DNA
atatgcaagtcactatag

SEQ ID NO: 73302 - DNA, 18 bp, Artificial Sequence
  Synthetic DNA
atttacgtctcactaaag

SEQ ID NO: 73303 - DNA, 18 bp, Artificial Sequence
  Synthetic DNA
caaaccaacacaaaatag

SEQ ID NO: 73304 - DNA, 18 bp, Artificial Sequence
  Synthetic DNA
taaaaagactcattttgg

SEQ ID NO: 73305 - DNA, 18 bp, Artificial Sequence
  Synthetic DNA
taaaacgtctctccttag

SEQ ID NO: 73306 - DNA, 18 bp, Artificial Sequence
  Synthetic DNA
taaatcgtctcacttaag

SEQ ID NO: 73307 - DNA, 18 bp, Artificial Sequence
  Synthetic DNA
taatacagttcactgttg

SEQ ID NO: 73308 - DNA, 18 bp, Artificial Sequence
  Synthetic DNA
taatacgacacacctatg

SEQ ID NO: 73309 - DNA, 18 bp, Artificial Sequence
  Synthetic DNA
taatactacaaactgttg

SEQ ID NO: 73310 - DNA, 18 bp, Artificial Sequence
  Synthetic DNA
taatactactttatattg

SEQ ID NO: 73311 - DNA, 18 bp, Artificial Sequence
  Synthetic DNA
taatgcgcctctctcaag

SEQ ID NO: 73312 - DNA, 18 bp, Artificial Sequence
  Synthetic DNA
taattcgagtctatattg

SEQ ID NO: 73313 - DNA, 18 bp, Artificial Sequence
  Synthetic DNA
tactaagaatctctttag

SEQ ID NO: 73314 - DNA, 18 bp, Artificial Sequence
  Synthetic DNA
tataacgacagtctatag

SEQ ID NO: 73315 - DNA, 18 bp, Artificial Sequence
  Synthetic DNA
tattacgattatccattg

SEQ ID NO: 73316 - DNA, 18 bp, Artificial Sequence
  Synthetic DNA
tatttctgctcacttcag

SEQ ID NO: 73317 - DNA, 18 bp, Artificial Sequence
  Synthetic DNA
tcatacgactcacatagg

SEQ ID NO: 73318 - DNA, 18 bp, Artificial Sequence
  Synthetic DNA
tcatacttctcacaattg

SEQ ID NO: 73319 - DNA, 18 bp, Artificial Sequence
  Synthetic DNA
tctttctactcactattg

SEQ ID NO: 73320 - DNA, 18 bp, Artificial Sequence
  Synthetic DNA
ttaatcgacactctatag

SEQ ID NO: 73321 - DNA, 18 bp, Artificial Sequence
  Synthetic DNA
ttatacgattaacaattg

SEQ ID NO: 73322 - DNA, 18 bp, Artificial Sequence
  Synthetic DNA
ttatgcgacttactgaag

SEQ ID NO: 73323 - DNA, 18 bp, Artificial Sequence
  Synthetic DNA
ttattcatctcactttag

SEQ ID NO: 73324 - DNA, 18 bp, Artificial Sequence
  Synthetic DNA
ttattcgtctctctctag

SEQ ID NO: 73325 - DNA, 18 bp, Artificial Sequence
  Synthetic DNA
ttattcgtttcactattg

SEQ ID NO: 73326 - DNA, 18 bp, Artificial Sequence
  Synthetic DNA
tttaacgactcacattag

SEQ ID NO: 73327 - DNA, 18 bp, Artificial Sequence
  Synthetic DNA
aaaatcgtcttactatag

SEQ ID NO: 73328 - DNA, 18 bp, Artificial Sequence
  Synthetic DNA
atatacgacacacaattg

SEQ ID NO: 73329 - DNA, 18 bp, Artificial Sequence
  Synthetic DNA
atatacgattcacttttg

SEQ ID NO: 73330 - DNA, 18 bp, Artificial Sequence
  Synthetic DNA
atatacttctcactaaag

SEQ ID NO: 73331 - DNA, 18 bp, Artificial Sequence
  Synthetic DNA
caatgcgtctcactaatg

SEQ ID NO: 73332 - DNA, 18 bp, Artificial Sequence
  Synthetic DNA
ctatacgaaacacaatag

SEQ ID NO: 73333 - DNA, 18 bp, Artificial Sequence
  Synthetic DNA
taaaatgtctcgttatcg

SEQ ID NO: 73334 - DNA, 18 bp, Artificial Sequence
  Synthetic DNA
taatacaactcatttatg

SEQ ID NO: 73335 - DNA, 18 bp, Artificial Sequence
  Synthetic DNA
taatactactatatattg

SEQ ID NO: 73336 - DNA, 18 bp, Artificial Sequence
  Synthetic DNA
taatacttaacacattag

SEQ ID NO: 73337 - DNA, 18 bp, Artificial Sequence
  Synthetic DNA
taatacttctcgataaag

SEQ ID NO: 73338 - DNA, 18 bp, Artificial Sequence
  Synthetic DNA
taatgcttctctctattg

SEQ ID NO: 73339 - DNA, 18 bp, Artificial Sequence
  Synthetic DNA
taattcatctcactaatg

SEQ ID NO: 73340 - DNA, 18 bp, Artificial Sequence
  Synthetic DNA
taattctactctcattag

SEQ ID NO: 73341 - DNA, 18 bp, Artificial Sequence
  Synthetic DNA
taattcttttaactatag

SEQ ID NO: 73342 - DNA, 18 bp, Artificial Sequence
  Synthetic DNA
tactccgtatccctagag

SEQ ID NO: 73343 - DNA, 18 bp, Artificial Sequence
  Synthetic DNA
tatatcttctcactatag

SEQ ID NO: 73344 - DNA, 18 bp, Artificial Sequence
  Synthetic DNA
tatcacgtcttactttag

SEQ ID NO: 73345 - DNA, 18 bp, Artificial Sequence
  Synthetic DNA
tattacgtcacacaaaag

SEQ ID NO: 73346 - DNA, 18 bp, Artificial Sequence
  Synthetic DNA
tcatacaaatctctttag

SEQ ID NO: 73347 - DNA, 18 bp, Artificial Sequence
  Synthetic DNA
tgtttatactcactatag

SEQ ID NO: 73348 - DNA, 18 bp, Artificial Sequence
  Synthetic DNA
ttatacgaatcaattttg

SEQ ID NO: 73349 - DNA, 18 bp, Artificial Sequence
  Synthetic DNA
ttatacgacttacatatg

SEQ ID NO: 73350 - DNA, 18 bp, Artificial Sequence
  Synthetic DNA
ttatacgattcggtaatg

SEQ ID NO: 73351 - DNA, 18 bp, Artificial Sequence
  Synthetic DNA
ttattcgtctcacattag

SEQ ID NO: 73352 - DNA, 18 bp, Artificial Sequence
  Synthetic DNA
ttgaacgactccctttag

SEQ ID NO: 73353 - DNA, 18 bp, Artificial Sequence
  Synthetic DNA
ttttacttctcactttag

SEQ ID NO: 73354 - DNA, 18 bp, Artificial Sequence
  Synthetic DNA
taatacgtcactcaattg

SEQ ID NO: 73355 - DNA, 18 bp, Artificial Sequence
  Synthetic DNA
agaaacgactcacaatcg

SEQ ID NO: 73356 - DNA, 18 bp, Artificial Sequence
  Synthetic DNA
atatatatctcactatag

SEQ ID NO: 73357 - DNA, 18 bp, Artificial Sequence
  Synthetic DNA
atatccgtcacactatag

SEQ ID NO: 73358 - DNA, 18 bp, Artificial Sequence
  Synthetic DNA
taaaaaggctctctaaag

SEQ ID NO: 73359 - DNA, 18 bp, Artificial Sequence
  Synthetic DNA
taatacgaatctataatg

SEQ ID NO: 73360 - DNA, 18 bp, Artificial Sequence
  Synthetic DNA
tacttcccctctttcttg

SEQ ID NO: 73361 - DNA, 18 bp, Artificial Sequence
  Synthetic DNA
tataaagtctctctatag

SEQ ID NO: 73362 - DNA, 18 bp, Artificial Sequence
  Synthetic DNA
tattaagtctcaatttag

SEQ ID NO: 73363 - DNA, 18 bp, Artificial Sequence
  Synthetic DNA
tatttcgacacacttttg

SEQ ID NO: 73364 - DNA, 18 bp, Artificial Sequence
  Synthetic DNA
tcatacgacactctaatg

SEQ ID NO: 73365 - DNA, 18 bp, Artificial Sequence
  Synthetic DNA
tgattcaactcacaattg

SEQ ID NO: 73366 - DNA, 18 bp, Artificial Sequence
  Synthetic DNA
tgattcgactctcttaag

SEQ ID NO: 73367 - DNA, 18 bp, Artificial Sequence
  Synthetic DNA
ttatacgaatttctattg

SEQ ID NO: 73368 - DNA, 18 bp, Artificial Sequence
  Synthetic DNA
ttttacgacactttatag

SEQ ID NO: 73369 - DNA, 18 bp, Artificial Sequence
  Synthetic DNA
ttttcctactcactattg

SEQ ID NO: 73370 - DNA, 18 bp, Artificial Sequence
  Synthetic DNA
aaatgcgaaacactattg

SEQ ID NO: 73371 - DNA, 18 bp, Artificial Sequence
  Synthetic DNA
aaatgcgattcacattag

SEQ ID NO: 73372 - DNA, 18 bp, Artificial Sequence
  Synthetic DNA
aaattcgtctcacaaaag

SEQ ID NO: 73373 - DNA, 18 bp, Artificial Sequence
  Synthetic DNA
aagtacgattctctttag

SEQ ID NO: 73374 - DNA, 18 bp, Artificial Sequence
  Synthetic DNA
aataacgactcacattag

SEQ ID NO: 73375 - DNA, 18 bp, Artificial Sequence
  Synthetic DNA
aatttcgtctcactattg

SEQ ID NO: 73376 - DNA, 18 bp, Artificial Sequence
  Synthetic DNA
atatacgactcacatttg

SEQ ID NO: 73377 - DNA, 18 bp, Artificial Sequence
  Synthetic DNA
taaaacaactatctattg

SEQ ID NO: 73378 - DNA, 18 bp, Artificial Sequence
  Synthetic DNA
taattcgacactttaaag

SEQ ID NO: 73379 - DNA, 18 bp, Artificial Sequence
  Synthetic DNA
taattcgtctcatttaag

SEQ ID NO: 73380 - DNA, 18 bp, Artificial Sequence
  Synthetic DNA
taattcgtttcagtattg

SEQ ID NO: 73381 - DNA, 18 bp, Artificial Sequence
  Synthetic DNA
tagtacttctcaccattg

SEQ ID NO: 73382 - DNA, 18 bp, Artificial Sequence
  Synthetic DNA
tataacgtcacactaaag

SEQ ID NO: 73383 - DNA, 18 bp, Artificial Sequence
  Synthetic DNA
tataacgtctcactcaag

SEQ ID NO: 73384 - DNA, 18 bp, Artificial Sequence
  Synthetic DNA
tattacgattctttattg

SEQ ID NO: 73385 - DNA, 18 bp, Artificial Sequence
  Synthetic DNA
tattataactcacataag

SEQ ID NO: 73386 - DNA, 18 bp, Artificial Sequence
  Synthetic DNA
tgatacgtttcaaaaaag

SEQ ID NO: 73387 - DNA, 18 bp, Artificial Sequence
  Synthetic DNA
ttaaaccactcacttttg

SEQ ID NO: 73388 - DNA, 18 bp, Artificial Sequence
  Synthetic DNA
ttatacttcacactttag

SEQ ID NO: 73389 - DNA, 18 bp, Artificial Sequence
  Synthetic DNA
ttatgcaactctgtattg

SEQ ID NO: 73390 - DNA, 18 bp, Artificial Sequence
  Synthetic DNA
tttaacgactcacaaaag

SEQ ID NO: 73391 - DNA, 18 bp, Artificial Sequence
  Synthetic DNA
aaataccactctctgttg

SEQ ID NO: 73392 - DNA, 18 bp, Artificial Sequence
  Synthetic DNA
aattacgattcacattag

SEQ ID NO: 73393 - DNA, 18 bp, Artificial Sequence
  Synthetic DNA
aattactactctctacag

SEQ ID NO: 73394 - DNA, 18 bp, Artificial Sequence
  Synthetic DNA
acatacgtccaactatag

SEQ ID NO: 73395 - DNA, 18 bp, Artificial Sequence
  Synthetic DNA
atatacgactctatttag

SEQ ID NO: 73396 - DNA, 18 bp, Artificial Sequence
  Synthetic DNA
atttttgactcactatag

SEQ ID NO: 73397 - DNA, 18 bp, Artificial Sequence
  Synthetic DNA
ccttacgaatctctatag

SEQ ID NO: 73398 - DNA, 18 bp, Artificial Sequence
  Synthetic DNA
taaaatgtcacattttag

SEQ ID NO: 73399 - DNA, 18 bp, Artificial Sequence
  Synthetic DNA
taatacaactcacatatg

SEQ ID NO: 73400 - DNA, 18 bp, Artificial Sequence
  Synthetic DNA
taatacgtctctcaaatg

SEQ ID NO: 73401 - DNA, 18 bp, Artificial Sequence
  Synthetic DNA
taatccgtcacacttttg

SEQ ID NO: 73402 - DNA, 18 bp, Artificial Sequence
  Synthetic DNA
tataacgtttcactattg

SEQ ID NO: 73403 - DNA, 18 bp, Artificial Sequence
  Synthetic DNA
tattacttttcaatatag

SEQ ID NO: 73404 - DNA, 18 bp, Artificial Sequence
  Synthetic DNA
tatttcgccacacaatag

SEQ ID NO: 73405 - DNA, 18 bp, Artificial Sequence
  Synthetic DNA
tatttctactctcaatag

SEQ ID NO: 73406 - DNA, 18 bp, Artificial Sequence
  Synthetic DNA
tgattcgtctctctattg

SEQ ID NO: 73407 - DNA, 18 bp, Artificial Sequence
  Synthetic DNA
ttaatccactcactattg

SEQ ID NO: 73408 - DNA, 18 bp, Artificial Sequence
  Synthetic DNA
ttatacttttcacaatag

SEQ ID NO: 73409 - DNA, 18 bp, Artificial Sequence
  Synthetic DNA
tttaactactcactaaag

SEQ ID NO: 73410 - DNA, 18 bp, Artificial Sequence
  Synthetic DNA
aaattcatctcactgtag

SEQ ID NO: 73411 - DNA, 18 bp, Artificial Sequence
  Synthetic DNA
aattaagtctcactattg

SEQ ID NO: 73412 - DNA, 18 bp, Artificial Sequence
  Synthetic DNA
taatactactttctaatg

SEQ ID NO: 73413 - DNA, 18 bp, Artificial Sequence
  Synthetic DNA
taatataacattctatag

SEQ ID NO: 73414 - DNA, 18 bp, Artificial Sequence
  Synthetic DNA
taattggattcacttttg

SEQ ID NO: 73415 - DNA, 18 bp, Artificial Sequence
  Synthetic DNA
tagattgactcacaatag

SEQ ID NO: 73416 - DNA, 18 bp, Artificial Sequence
  Synthetic DNA
tatttcatcacactatag

SEQ ID NO: 73417 - DNA, 18 bp, Artificial Sequence
  Synthetic DNA
tatttcgacaaactacag

SEQ ID NO: 73418 - DNA, 18 bp, Artificial Sequence
  Synthetic DNA
tcatccgtctaactattg

SEQ ID NO: 73419 - DNA, 18 bp, Artificial Sequence
  Synthetic DNA
ttaaacgactcacaaatg

SEQ ID NO: 73420 - DNA, 18 bp, Artificial Sequence
  Synthetic DNA
aaatccgtcacactttag

SEQ ID NO: 73421 - DNA, 18 bp, Artificial Sequence
  Synthetic DNA
atatacgactatcaatag

SEQ ID NO: 73422 - DNA, 18 bp, Artificial Sequence
  Synthetic DNA
taatacatcacacaagag

SEQ ID NO: 73423 - DNA, 18 bp, Artificial Sequence
  Synthetic DNA
taatatgtctctcttaag

SEQ ID NO: 73424 - DNA, 18 bp, Artificial Sequence
  Synthetic DNA
ttatacaactctcattag

SEQ ID NO: 73425 - DNA, 18 bp, Artificial Sequence
  Synthetic DNA
taaaacgaacaactattg

SEQ ID NO: 73426 - DNA, 18 bp, Artificial Sequence
  Synthetic DNA
taaaactactcatattag

SEQ ID NO: 73427 - DNA, 18 bp, Artificial Sequence
  Synthetic DNA
taatacatctcgcaattg

SEQ ID NO: 73428 - DNA, 18 bp, Artificial Sequence
  Synthetic DNA
taatacgaatcatttatg

SEQ ID NO: 73429 - DNA, 18 bp, Artificial Sequence
  Synthetic DNA
taatacgtttatctattg

SEQ ID NO: 73430 - DNA, 18 bp, Artificial Sequence
  Synthetic DNA
tataaagactcacattag

SEQ ID NO: 73431 - DNA, 18 bp, Artificial Sequence
  Synthetic DNA
tcatattactgactgtag

SEQ ID NO: 73432 - DNA, 18 bp, Artificial Sequence
  Synthetic DNA
ttatacgtttcaacatag

SEQ ID NO: 73433 - DNA, 18 bp, Artificial Sequence
  Synthetic DNA
ttatataactcacttttg

SEQ ID NO: 73434 - DNA, 18 bp, Artificial Sequence
  Synthetic DNA
aaatacgtcaaaccatag

SEQ ID NO: 73435 - DNA, 18 bp, Artificial Sequence
  Synthetic DNA
atattcgactctcaatag

SEQ ID NO: 73436 - DNA, 18 bp, Artificial Sequence
  Synthetic DNA
taatacttcactctaaag

SEQ ID NO: 73437 - DNA, 18 bp, Artificial Sequence
  Synthetic DNA
ttatacgactcaaatttg

SEQ ID NO: 73438 - DNA, 18 bp, Artificial Sequence
  Synthetic DNA
ttatacgattctctcttg

SEQ ID NO: 73439 - DNA, 18 bp, Artificial Sequence
  Synthetic DNA
ttatatgtctctctttag

SEQ ID NO: 73440 - DNA, 18 bp, Artificial Sequence
  Synthetic DNA
cattacgatcgaatatag

SEQ ID NO: 73441 - DNA, 18 bp, Artificial Sequence
  Synthetic DNA
taattatactcacttttg

SEQ ID NO: 73442 - DNA, 18 bp, Artificial Sequence
  Synthetic DNA
tataacgaatctcaatag

SEQ ID NO: 73443 - DNA, 18 bp, Artificial Sequence
  Synthetic DNA
tatttcgaatcacaattg

SEQ ID NO: 73444 - DNA, 18 bp, Artificial Sequence
  Synthetic DNA
ttatacctatcactttag

SEQ ID NO: 73445 - DNA, 18 bp, Artificial Sequence
  Synthetic DNA
ttatacgtctctatttag

SEQ ID NO: 73446 - DNA, 18 bp, Artificial Sequence
  Synthetic DNA
ttgtacgtctcaatattg

SEQ ID NO: 73447 - DNA, 18 bp, Artificial Sequence
  Synthetic DNA
aaaattgtctcactatag

SEQ ID NO: 73448 - DNA, 18 bp, Artificial Sequence
  Synthetic DNA
atatactactcgctattg

SEQ ID NO: 73449 - DNA, 18 bp, Artificial Sequence
  Synthetic DNA
atttacgtctcaatatag

SEQ ID NO: 73450 - DNA, 18 bp, Artificial Sequence
  Synthetic DNA
taattcaacatacaatag

SEQ ID NO: 73451 - DNA, 18 bp, Artificial Sequence
  Synthetic DNA
tataacgtctcacaaaag

SEQ ID NO: 73452 - DNA, 18 bp, Artificial Sequence
  Synthetic DNA
tataacgtctcacttaag

SEQ ID NO: 73453 - DNA, 18 bp, Artificial Sequence
  Synthetic DNA
taatacgacaaacacaag

SEQ ID NO: 73454 - DNA, 18 bp, Artificial Sequence
  Synthetic DNA
tattacgtcacaatttag

SEQ ID NO: 73455 - DNA, 18 bp, Artificial Sequence
  Synthetic DNA
tatttcgacacacaaaag

SEQ ID NO: 73456 - DNA, 18 bp, Artificial Sequence
  Synthetic DNA
taattcgaatcacttatg

SEQ ID NO: 73457 - DNA, 18 bp, Artificial Sequence
  Synthetic DNA
tattaagacttacaattg

SEQ ID NO: 73458 - DNA, 18 bp, Artificial Sequence
  Synthetic DNA
ttatacgtctctctaatg

SEQ ID NO: 73459 - DNA, 18 bp, Artificial Sequence
  Synthetic DNA
aatttcgactcacttttg

SEQ ID NO: 73460 - DNA, 18 bp, Artificial Sequence
  Synthetic DNA
ataaacaactctctatag

SEQ ID NO: 73461 - DNA, 18 bp, Artificial Sequence
  Synthetic DNA
ttatacgacaaacaattg

SEQ ID NO: 73462 - DNA, 18 bp, Artificial Sequence
  Synthetic DNA
ttatgctactcacaattg

SEQ ID NO: 73463 - DNA, 18 bp, Artificial Sequence
  Synthetic DNA
atatacgactcacataag

SEQ ID NO: 73464 - DNA, 18 bp, Artificial Sequence
  Synthetic DNA
tttaaagactcactaaag

SEQ ID NO: 73465 - DNA, 18 bp, Artificial Sequence
  Synthetic DNA
tacaccgacacattatgg

SEQ ID NO: 73466 - DNA, 18 bp, Artificial Sequence
  Synthetic DNA
tataacaactcacattag

SEQ ID NO: 73467 - DNA, 18 bp, Artificial Sequence
  Synthetic DNA
taataagtcactctaaag

SEQ ID NO: 73468 - DNA, 18 bp, Artificial Sequence
  Synthetic DNA
tattacgacacacataag

SEQ ID NO: 73469 - DNA, 18 bp, Artificial Sequence
  Synthetic DNA
tattataactcacaaaag

SEQ ID NO: 73470 - DNA, 18 bp, Artificial Sequence
  Synthetic DNA
ttttactactctctattg

SEQ ID NO: 73471 - DNA, 18 bp, Artificial Sequence
  Synthetic DNA
tatatcgactctctattg

SEQ ID NO: 73472 - DNA, 18 bp, Artificial Sequence
  Synthetic DNA
ttatatttctcactttag

SEQ ID NO: 73473 - DNA, 18 bp, Artificial Sequence
  Synthetic DNA
ttattctactctcaatag
